(12) United States Patent
Feldhaus et al.

(10) Patent No.: US 10,047,157 B2
(45) Date of Patent: Aug. 14, 2018

(54) HUMANIZED ANTI-ACTH ANTIBODIES AND USE THEREOF

(71) Applicant: ALDER BIOPHARMACEUTICALS, INC., Bothell, WA (US)

(72) Inventors: Andrew Lawrence Feldhaus, Lynnwood, WA (US); Leon F. Garcia-Martinez, Woodinville, WA (US); Benjamin H. Dutzar, Seattle, WA (US); Daniel S. Allison, Lake Forest Park, WA (US); Katie Olson Anderson, Kirkland, WA (US); Ethan Wayne Ojala, Snohomish, WA (US); Pei Fan, Bothell, WA (US); Charlie Karasek, Seattle, WA (US); Jenny A. Mulligan, Lake Forest Park, WA (US); Danielle Marie Mitchell, Seattle, WA (US); Patricia Dianne McNeill, Federal Way, WA (US); Michelle L. Scalley-Kim, Seattle, WA (US); Erica Stewart, Seattle, WA (US); Jeffrey T. L. Smith, Bellevue, WA (US); John Latham, Seattle, WA (US)

(73) Assignee: ALDER BIOPHARMACEUTICALS, INC., Bothell, WA (US)

( * ) Notice: Subject to any disclaimer, the term of this patent is extended or adjusted under 35 U.S.C. 154(b) by 0 days.

(21) Appl. No.: 14/974,908

(22) Filed: Dec. 18, 2015

(65) Prior Publication Data

US 2016/0215049 A1  Jul. 28, 2016

Related U.S. Application Data

(60) Provisional application No. 62/094,805, filed on Dec. 19, 2014, provisional application No. 62/118,563, filed on Feb. 20, 2015, provisional application No. 62/207,284, filed on Aug. 19, 2015.

(51) Int. Cl.
| | |
|---|---|
| *C07K 16/26* | (2006.01) |
| *A61K 39/395* | (2006.01) |
| *A61K 45/06* | (2006.01) |
| *C07K 16/42* | (2006.01) |
| *A61K 39/00* | (2006.01) |

(52) U.S. Cl.
CPC ............ *C07K 16/26* (2013.01); *A61K 39/395* (2013.01); *A61K 39/3955* (2013.01); *A61K 45/06* (2013.01); *C07K 16/4241* (2013.01); *A61K 2039/505* (2013.01); *C07K 2317/21* (2013.01); *C07K 2317/24* (2013.01); *C07K 2317/76* (2013.01); *C07K 2317/92* (2013.01)

(58) Field of Classification Search
None
See application file for complete search history.

(56) References Cited

U.S. PATENT DOCUMENTS

2012/0309696 A1   12/2012   Dores

FOREIGN PATENT DOCUMENTS

| DE | 2442569 A1 | 3/1976 |
| EP | 310413 A2 | 4/1989 |
| WO | 2006052468 | 5/2006 |
| WO | 2015127288 | 8/2015 |

OTHER PUBLICATIONS

White et al., Clinical Endocrinology, 26:41-52, 1987.*
Fleischer et al. Studies of ACTH antibodies and their reactions with inactive analogues of ACTH. Endocrinology. May 1966;78(5):1067-75.
Fleischer et al. ACTH antibodies in patients receiving depot porcine ACTH to hasten recovery from pituitary-adrenal suppression. Journal of Clinical Investigation. Feb. 1967;46(2):196.
Gan et al. Spontaneous and tetracosactide-induced anti-ACTH antibodies in man. Clinical endocrinology. Jun. 25, 2015, vol. 84, Iss. 4, pp. 489-495.
White A, Gray C, Ratcliffe JG. Characterisation of monoclonal antibodies to adrenocorticotrophin. Journal of immunological methods. May 23, 1985;79(2):185-94.
Shimazaki Y, Kohno Y, Fukui I, Koyashiki T. Epitope analysis using membrane-immobilized avidin and protein A. Protein expression and purification. Jun. 30, 2012;83(2):177-81.
Brown M, Rittenburg MB, Chen C, Roberts VA. Tolerance of single, but not multiple, amino acid replacements in antibody VH CDR 2: a means of minimizing B cell wastage from somatic hypermutation?. The Journal of Immunology. May 1, 1996;156(9):3285-91.

* cited by examiner

*Primary Examiner* — Marianne P Allen
(74) *Attorney, Agent, or Firm* — Robin L. Teskin; LeClairRyan PLLC

(57) ABSTRACT

The present invention is directed to antibodies and fragments thereof having binding specificity for ACTH. Embodiments of this invention relate to the binding fragments of antibodies described herein, comprising the sequences of the $V_H$, $V_L$ and/or CDR polypeptides described herein, and the polynucleotides encoding them. The invention also contemplates anti-ACTH antibodies and binding fragments thereof conjugated to one or more functional or detectable moieties. The invention further contemplates methods of making said anti-ACTH antibodies and binding fragments thereof. Embodiments of the invention also pertain to the use of anti-ACTH antibodies and binding fragments thereof for the diagnosis, assessment, prevention and treatment of diseases and disorders associated with ACTH, such as CAH, FGD, Cushing's Disease, Cushing's Syndrome, Parkinson's disease, obesity, diabetes, sleep disorders, depression, anxiety disorders, cancer, muscle atrophy, hypertension, hyperinsulinemia, cognitive dysfunction, Alzheimer's disease, galactorrhea, stress related conditions, cardiac conditions, metabolic syndrome, hyperaldosteronism, Conn's syndrome and familial hyperaldosteronism.

11 Claims, 163 Drawing Sheets

FIG. 1A
Antibody Heavy chain Protein features

| Sequence Name | FR1 | CDR1 | FR2 | CDR2 |
|---|---|---|---|---|
| Ab13 | QQLEESGGGLVKPGGTLTLTCTASGFSFS | SGYDIC | WARQGPGKGLEWIG | CIDTGSGNTYYASWAKG |
| Ab15 | QQLEESGGGLVKPGGTLTLTCKGSGIAFS | DTYDMC | WVRQAPGKGLEWIG | CIDTGSGDTYYPTWAKG |
| Ab17 | QQLEESGGGLVKPGGTLTLTCKASGFSFS | SGYDIC | WARQGPGKGLEWIG | CIDTGSGNTYYASWAKG |
| Ab1.H | EVQLVESGGGLVQPGGSLRLSCAASGFTVS | NYDMI | WVRQAPGKGLESIG | MIYDDGDTYYASSAKG |
| Ab2.H | EVQLVESGGGLVQPGGSLRLSCAASGFTVS | KYDMI | WVRQAPGKGLESIG | IIYDDGDTYYASSAKG |
| Ab3.H | EVQLVESGGGLVQPGGSLRLSCAASGSSLS | NFDMI | WVRQAPGKGLESIG | IIYDFGSTYYASSAKG |
| Ab4.H | EVQLVESGGGLVQPGGSLRLSCAASGFTVS | KHDMI | WVRQAPGKGLESIG | IIYDDGDTYYANSAKG |
| Ab6.H | EVQLVESGGGLVQPGGSLRLSCAASGFSLT | DYAMS | WVRQAPGKGLEWIG | IISDSGSTYYASSAKG |
| Ab7.H | EVQLVESGGGLVQPGGSLRLSCAASGFSLS | SYAMS | WVRQAPGKGLEWIG | IISDSGSTYYASSAKG |
| Ab7A.H | EVQLVESGGGLVQPGGSLRLSCAASGFSLS | SYAMS | WVRQAPGKGLEWIG | IISDSGSTYYASSAKG |
| Ab10.H | EVQLVESGGGLVQPGGSLRLSCAASGFTVS | SADMI | WVRQAPGKGLESIG | MIYDDGDTYYATSAKG |
| Ab11.H | EVQLVESGGGLVQPGGSLRLSCAASGFTVS | AYDIL | WVRQAPGKGLESIG | MMYDDGDTYYATSAKG |
| Ab11A.H | EVQLVESGGGLVQPGGSLRLSCAASGFTVS | AYDIL | WVRQAPGKGLESIG | MMYDDGDTYYATSAKG |
| Ab12.H | EVQLVESGGGLVQPGGSLRLSCAASGSSLS | DYDMI | WVRQAPGKGLESIG | IIYDDGDTYYATSAKG |
| Ab13.H | EVQLVESGGGLVQPGGSLRLSCAASGFTVS | SGYDIC | WVRQAPGKGLEWIG | CIDTGSGNTYYASSAKG |
| Ab15.H | QQQLVESGGGLVQPGGSLRLSCAASGFTVS | DTYDMC | WVRQAPGKGLEWIG | CIDTGSGDTYYPTSAKG |
| Ab17.H | QQQLVESGGGLVQPGGSLRLSCAASGFTVS | SGYDIC | WVRQAPGKGLEWIG | CIDTGSGNTYYASSAKG |

FIG. 1B
Antibody Heavy chain Protein features

| Sequence Name | FR3 | CDR3 | FR4 |
|---|---|---|---|
| Ab13 | RFTMSRTSSTTVTLQVTSLTAADTATYFCAK | GISSI | WGPGTLVTVSS |
| Ab15 | RFTISKPSSTTVDLKMTSLTAADTATYFCAK | GVSSL | WGQGTLVTVSS |
| Ab17 | RFTISRTSSTTVTLQMTSLTAADTATYFCAK | GISSL | WGPGTLVTVSS |
| Ab1.H | RFTISRDNSKNTLYLQMNSLRAEDTAVYYCVK | GVSNH | WGQGTLVTVSS |
| Ab2.H | RFTISRDNSKNTLYLQMNSLRAEDTAVYYCVK | GVSNI | WGQGTLVTVSS |
| Ab3.H | RFTISRDNSKNTLYLQMNSLRAEDTAVYYCVK | GVSNM | WGQGTLVTVSS |
| Ab4.H | RFTISRDNSKNTLYLQMNSLRAEDTAVYYCVK | GVSNI | WGQGTLVTVSS |
| Ab6.H | RFTISRDNSKNTLYLQMNSLRAEDTAVYYCAR | EPEYGYDEYGDWVSDL | WGQGTLVTVSS |
| Ab7.H | RFTISRDNSKNTLYLQMNSLRAEDTAVYYCAR | EPEYGYDDYGDWVSDL | WGQGTLVTVSS |
| Ab7A.H | RFTISRDNSKNTLYLQMNSLRAEDTAVYYCAR | EPEYGYDDYGDWVSDL | WGQGTLVTVSS |
| Ab10.H | RFTISRDNSKNTLYLQMNSLRAEDTAVYYCVK | GVSSV | WGQGTLVTVSS |
| Ab11.H | RFTISRDNSKNTLYLQMNSLRAEDTAVYYCVK | GVSNI | WGQGTLVTVSS |
| Ab11A.H | RFTISRDNSKNTLYLQMNSLRAEDTAVYYCVK | GVSNI | WGQGTLVTVSS |
| Ab12.H | RFTISRDNSKNTLYLQMNSLRAEDTAVYYCVK | GVSNM | WGQGTLVTVSS |
| Ab13.H | RFTMSRDNSKNTVYLQMNSLRAEDTAVYYCAK | GISSI | WGQGTLVTVSS |
| Ab15.H | RFTISRDNSKNTLYLQMNSLRAEDTAVYYCAK | GVSSL | WGQGTLVTVSS |
| Ab17.H | RFTISRDNSKNTLYLQMNSLRAEDTAVYYCAK | GISSL | WGQGTLVTVSS |

FIG. 1C
Antibody Heavy chain Protein features

| Sequence Name | | Constant region |
|---|---|---|
| Ab13 | ASTKGPSVFPLAPSSKSTSGGTAALGCLVKDYFPEPVTVSWNSGALTSGVHTFPAVLQSSGLYSLSSVVTVPSSSL |
| Ab15 | ASTKGPSVFPLAPSSKSTSGGTAALGCLVKDYFPEPVTVSWNSGALTSGVHTFPAVLQSSGLYSLSSVVTVPSSSL |
| Ab17 | ASTKGPSVFPLAPSSKSTSGGTAALGCLVKDYFPEPVTVSWNSGALTSGVHTFPAVLQSSGLYSLSSVVTVPSSSL |
| Ab1.H | ASTKGPSVFPLAPSSKSTSGGTAALGCLVKDYFPEPVTVSWNSGALTSGVHTFPAVLQSSGLYSLSSVVTVPSSSL |
| Ab2.H | ASTKGPSVFPLAPSSKSTSGGTAALGCLVKDYFPEPVTVSWNSGALTSGVHTFPAVLQSSGLYSLSSVVTVPSSSL |
| Ab3.H | ASTKGPSVFPLAPSSKSTSGGTAALGCLVKDYFPEPVTVSWNSGALTSGVHTFPAVLQSSGLYSLSSVVTVPSSSL |
| Ab4.H | ASTKGPSVFPLAPSSKSTSGGTAALGCLVKDYFPEPVTVSWNSGALTSGVHTFPAVLQSSGLYSLSSVVTVPSSSL |
| Ab6.H | ASTKGPSVFPLAPSSKSTSGGTAALGCLVKDYFPEPVTVSWNSGALTSGVHTFPAVLQSSGLYSLSSVVTVPSSSL |
| Ab7.H | ASTKGPSVFPLAPSSKSTSGGTAALGCLVKDYFPEPVTVSWNSGALTSGVHTFPAVLQSSGLYSLSSVVTVPSSSL |
| Ab7A.H | ASTKGPSVFPLAPSSKSTSGGTAALGCLVKDYFPEPVTVSWNSGALTSGVHTFPAVLQSSGLYSLSSVVTVPSSSL |
| Ab10.H | ASTKGPSVFPLAPSSKSTSGGTAALGCLVKDYFPEPVTVSWNSGALTSGVHTFPAVLQSSGLYSLSSVVTVPSSSL |
| Ab11.H | ASTKGPSVFPLAPSSKSTSGGTAALGCLVKDYFPEPVTVSWNSGALTSGVHTFPAVLQSSGLYSLSSVVTVPSSSL |
| Ab11A.H | ASTKGPSVFPLAPSSKSTSGGTAALGCLVKDYFPEPVTVSWNSGALTSGVHTFPAVLQSSGLYSLSSVVTVPSSSL |
| Ab12.H | ASTKGPSVFPLAPSSKSTSGGTAALGCLVKDYFPEPVTVSWNSGALTSGVHTFPAVLQSSGLYSLSSVVTVPSSSL |
| Ab13.H | ASTKGPSVFPLAPSSKSTSGGTAALGCLVKDYFPEPVTVSWNSGALTSGVHTFPAVLQSSGLYSLSSVVTVPSSSL |
| Ab15.H | ASTKGPSVFPLAPSSKSTSGGTAALGCLVKDYFPEPVTVSWNSGALTSGVHTFPAVLQSSGLYSLSSVVTVPSSSL |
| Ab17.H | ASTKGPSVFPLAPSSKSTSGGTAALGCLVKDYFPEPVTVSWNSGALTSGVHTFPAVLQSSGLYSLSSVVTVPSSSL |

FIG. 1D
Antibody Heavy chain Protein features

| Sequence Name | Constant region |
|---|---|
| Ab13 | GTQTYICNVNHKPSNTKVDARVEPKSCDKTHTCPPCPAPELLGGPSVFLFPPKPKDTLMISRTPEVTCVVVDVSH |
| Ab15 | GTQTYICNVNHKPSNTKVDARVEPKSCDKTHTCPPCPAPELLGGPSVFLFPPKPKDTLMISRTPEVTCVVVDVSH |
| Ab17 | GTQTYICNVNHKPSNTKVDARVEPKSCDKTHTCPPCPAPELLGGPSVFLFPPKPKDTLMISRTPEVTCVVVDVSH |
| Ab1.H | GTQTYICNVNHKPSNTKVDARVEPKSCDKTHTCPPCPAPELLGGPSVFLFPPKPKDTLMISRTPEVTCVVVDVSH |
| Ab2.H | GTQTYICNVNHKPSNTKVDARVEPKSCDKTHTCPPCPAPELLGGPSVFLFPPKPKDTLMISRTPEVTCVVVDVSH |
| Ab3.H | GTQTYICNVNHKPSNTKVDARVEPKSCDKTHTCPPCPAPELLGGPSVFLFPPKPKDTLMISRTPEVTCVVVDVSH |
| Ab4.H | GTQTYICNVNHKPSNTKVDARVEPKSCDKTHTCPPCPAPELLGGPSVFLFPPKPKDTLMISRTPEVTCVVVDVSH |
| Ab6.H | GTQTYICNVNHKPSNTKVDARVEPKSCDKTHTCPPCPAPELLGGPSVFLFPPKPKDTLMISRTPEVTCVVVDVSH |
| Ab7.H | GTQTYICNVNHKPSNTKVDARVEPKSCDKTHTCPPCPAPELLGGPSVFLFPPKPKDTLMISRTPEVTCVVVDVSH |
| Ab7A.H | GTQTYICNVNHKPSNTKVDARVEPKSCDKTHTCPPCPAPELLGGPSVFLFPPKPKDTLMISRTPEVTCVVVDVSH |
| Ab10.H | GTQTYICNVNHKPSNTKVDARVEPKSCDKTHTCPPCPAPELLGGPSVFLFPPKPKDTLMISRTPEVTCVVVDVSH |
| Ab11.H | GTQTYICNVNHKPSNTKVDKKVEPKSCDKTHTCPPCPAPELLGGPSVFLFPPKPKDTLMISRTPEVTCVVVDVSH |
| Ab11A.H | GTQTYICNVNHKPSNTKVDKKVEPKSCDKTHTCPPCPAPELLGGPSVFLFPPKPKDTLMISRTPEVTCVVVDVSH |
| Ab12.H | GTQTYICNVNHKPSNTKVDARVEPKSCDKTHTCPPCPAPELLGGPSVFLFPPKPKDTLMISRTPEVTCVVVDVSH |
| Ab13.H | GTQTYICNVNHKPSNTKVDKKVEPKSCDKTHTCPPCPAPELLGGPSVFLFPPKPKDTLMISRTPEVTCVVVDVSH |
| Ab15.H | GTQTYICNVNHKPSNTKVDARVEPKSCDKTHTCPPCPAPELLGGPSVFLFPPKPKDTLMISRTPEVTCVVVDVSH |
| Ab17.H | GTQTYICNVNHKPSNTKVDARVEPKSCDKTHTCPPCPAPELLGGPSVFLFPPKPKDTLMISRTPEVTCVVVDVSH |

FIG. 1E
Antibody Heavy chain Protein features

| Sequence Name | Constant region |
|---|---|
| Ab13 | EDPEVKFNWYVDGVEVHNAKTKPREEQYASTYRVVSVLTVLHQDWLNGKEYKCKVSNKALPAPIEKTISKAKGQP |
| Ab15 | EDPEVKFNWYVDGVEVHNAKTKPREEQYASTYRVVSVLTVLHQDWLNGKEYKCKVSNKALPAPIEKTISKAKGQP |
| Ab17 | EDPEVKFNWYVDGVEVHNAKTKPREEQYASTYRVVSVLTVLHQDWLNGKEYKCKVSNKALPAPIEKTISKAKGQP |
| Ab1.H | EDPEVKFNWYVDGVEVHNAKTKPREEQYASTYRVVSVLTVLHQDWLNGKEYKCKVSNKALPAPIEKTISKAKGQP |
| Ab2.H | EDPEVKFNWYVDGVEVHNAKTKPREEQYASTYRVVSVLTVLHQDWLNGKEYKCKVSNKALPAPIEKTISKAKGQP |
| Ab3.H | EDPEVKFNWYVDGVEVHNAKTKPREEQYASTYRVVSVLTVLHQDWLNGKEYKCKVSNKALPAPIEKTISKAKGQP |
| Ab4.H | EDPEVKFNWYVDGVEVHNAKTKPREEQYASTYRVVSVLTVLHQDWLNGKEYKCKVSNKALPAPIEKTISKAKGQP |
| Ab6.H | EDPEVKFNWYVDGVEVHNAKTKPREEQYASTYRVVSVLTVLHQDWLNGKEYKCKVSNKALPAPIEKTISKAKGQP |
| Ab7.H | EDPEVKFNWYVDGVEVHNAKTKPREEQYASTYRVVSVLTVLHQDWLNGKEYKCKVSNKALPAPIEKTISKAKGQP |
| Ab7A.H | EDPEVKFNWYVDGVEVHNAKTKPREEQYASTYRVVSVLTVLHQDWLNGKEYKCKVSNKALPAPIEKTISKAKGQP |
| Ab10.H | EDPEVKFNWYVDGVEVHNAKTKPREEQYASTYRVVSVLTVLHQDWLNGKEYKCKVSNKALPAPIEKTISKAKGQP |
| Ab11.H | EDPEVKFNWYVDGVEVHNAKTKPREEQYASTYRVVSVLTVLHQDWLNGKEYKCKVSNKALPAPIEKTISKAKGQP |
| Ab11A.H | EDPEVKFNWYVDGVEVHNAKTKPREEQYASTYRVVSVLTVLHQDWLNGKEYKCKVSNKALPAPIEKTISKAKGQP |
| Ab12.H | EDPEVKFNWYVDGVEVHNAKTKPREEQYASTYRVVSVLTVLHQDWLNGKEYKCKVSNKALPAPIEKTISKAKGQP |
| Ab13.H | EDPEVKFNWYVDGVEVHNAKTKPREEQYASTYRVVSVLTVLHQDWLNGKEYKCKVSNKALPAPIEKTISKAKGQP |
| Ab15.H | EDPEVKFNWYVDGVEVHNAKTKPREEQYASTYRVVSVLTVLHQDWLNGKEYKCKVSNKALPAPIEKTISKAKGQP |
| Ab17.H | EDPEVKFNWYVDGVEVHNAKTKPREEQYASTYRVVSVLTVLHQDWLNGKEYKCKVSNKALPAPIEKTISKAKGQP |

FIG. 1F
Antibody Heavy chain Protein features

| Sequence Name | Constant region |
|---|---|
| Ab13 | REPQVYTLPPSREEMTKNQVSLTCLVKGFYPSDIAVEWESNGQPENNYKTTPPVLDSDGSFFLYSKLTVDKSRWQ |
| Ab15 | REPQVYTLPPSREEMTKNQVSLTCLVKGFYPSDIAVEWESNGQPENNYKTTPPVLDSDGSFFLYSKLTVDKSRWQ |
| Ab17 | REPQVYTLPPSREEMTKNQVSLTCLVKGFYPSDIAVEWESNGQPENNYKTTPPVLDSDGSFFLYSKLTVDKSRWQ |
| Ab1.H | REPQVYTLPPSREEMTKNQVSLTCLVKGFYPSDIAVEWESNGQPENNYKTTPPVLDSDGSFFLYSKLTVDKSRWQ |
| Ab2.H | REPQVYTLPPSREEMTKNQVSLTCLVKGFYPSDIAVEWESNGQPENNYKTTPPVLDSDGSFFLYSKLTVDKSRWQ |
| Ab3.H | REPQVYTLPPSREEMTKNQVSLTCLVKGFYPSDIAVEWESNGQPENNYKTTPPVLDSDGSFFLYSKLTVDKSRWQ |
| Ab4.H | REPQVYTLPPSREEMTKNQVSLTCLVKGFYPSDIAVEWESNGQPENNYKTTPPVLDSDGSFFLYSKLTVDKSRWQ |
| Ab6.H | REPQVYTLPPSREEMTKNQVSLTCLVKGFYPSDIAVEWESNGQPENNYKTTPPVLDSDGSFFLYSKLTVDKSRWQ |
| Ab7.H | REPQVYTLPPSREEMTKNQVSLTCLVKGFYPSDIAVEWESNGQPENNYKTTPPVLDSDGSFFLYSKLTVDKSRWQ |
| Ab7A.H | REPQVYTLPPSREEMTKNQVSLTCLVKGFYPSDIAVEWESNGQPENNYKTTPPVLDSDGSFFLYSKLTVDKSRWQ |
| Ab10.H | REPQVYTLPPSREEMTKNQVSLTCLVKGFYPSDIAVEWESNGQPENNYKTTPPVLDSDGSFFLYSKLTVDKSRWQ |
| Ab11.H | REPQVYTLPPSREEMTKNQVSLTCLVKGFYPSDIAVEWESNGQPENNYKTTPPVLDSDGSFFLYSKLTVDKSRWQ |
| Ab11A.H | REPQVYTLPPSREEMTKNQVSLTCLVKGFYPSDIAVEWESNGQPENNYKTTPPVLDSDGSFFLYSKLTVDKSRWQ |
| Ab12.H | REPQVYTLPPSREEMTKNQVSLTCLVKGFYPSDIAVEWESNGQPENNYKTTPPVLDSDGSFFLYSKLTVDKSRWQ |
| Ab13.H | REPQVYTLPPSREEMTKNQVSLTCLVKGFYPSDIAVEWESNGQPENNYKTTPPVLDSDGSFFLYSKLTVDKSRWQ |
| Ab15.H | REPQVYTLPPSREEMTKNQVSLTCLVKGFYPSDIAVEWESNGQPENNYKTTPPVLDSDGSFFLYSKLTVDKSRWQ |
| Ab17.H | REPQVYTLPPSREEMTKNQVSLTCLVKGFYPSDIAVEWESNGQPENNYKTTPPVLDSDGSFFLYSKLTVDKSRWQ |

FIG. 1G
Antibody Heavy chain Protein features

| Sequence Name | Constant region |
|---|---|
| Ab13 | QGNVFSCSVMHEALHNHYTQKSLSLSPGK (SEQ ID NO:1) |
| Ab15 | QGNVFSCSVMHEALHNHYTQKSLSLSPGK (SEQ ID NO:41) |
| Ab17 | QGNVFSCSVMHEALHNHYTQKSLSLSPGK (SEQ ID NO:81) |
| Ab1.H | QGNVFSCSVMHEALHNHYTQKSLSLSPGK (SEQ ID NO:121) |
| Ab2.H | QGNVFSCSVMHEALHNHYTQKSLSLSPGK (SEQ ID NO:161) |
| Ab3.H | QGNVFSCSVMHEALHNHYTQKSLSLSPGK (SEQ ID NO:201) |
| Ab4.H | QGNVFSCSVMHEALHNHYTQKSLSLSPGK (SEQ ID NO:241) |
| Ab6.H | QGNVFSCSVMHEALHNHYTQKSLSLSPGK (SEQ ID NO:281) |
| Ab7.H | QGNVFSCSVMHEALHNHYTQKSLSLSPGK (SEQ ID NO:321) |
| Ab7A.H | QGNVFSCSVMHEALHNHYTQKSLSLSPGK (SEQ ID NO:361) |
| Ab10.H | QGNVFSCSVMHEALHNHYTQKSLSLSPGK (SEQ ID NO:401) |
| Ab11.H | QGNVFSCSVMHEALHNHYTQKSLSLSPGK (SEQ ID NO:441) |
| Ab11A.H | QGNVFSCSVMHEALHNHYTQKSLSLSPGK (SEQ ID NO:481) |
| Ab12.H | QGNVFSCSVMHEALHNHYTQKSLSLSPGK (SEQ ID NO:521) |
| Ab13.H | QGNVFSCSVMHEALHNHYTQKSLSLSPGK (SEQ ID NO:561) |
| Ab15.H | QGNVFSCSVMHEALHNHYTQKSLSLSPGK (SEQ ID NO:601) |
| Ab17.H | QGNVFSCSVMHEALHNHYTQKSLSLSPGK (SEQ ID NO:641) |

FIG. 2A
Antibody Light chain Protein features

| Sequence Name | FR1 | CDR1 | FR2 | CDR2 |
|---|---|---|---|---|
| Ab13 | DIVMTQTPASVSEPVGGTVTIKC | QASQTISSDLA | WYQQKPGQPPKLLIY | AASKLTS |
| Ab15 | DIVMTQTPASVSEPVGGTVTIKC | QASEDIESDLA | WYQQKPGQPPKLLIY | GASTLKS |
| Ab17 | DIVMTQTPASVSEPVGGTVTIKC | QASQTISSDLA | WYQQKPGQPPKLLIY | AASKLTS |
| Ab1.H | DIQMTQSPSTLSASVGDRVTITC | QASQSISSYLA | WYQQKPGKAPKLLIY | SASTLAS |
| Ab2.H | DIQMTQSPSTLSASVGDRVTITC | QASQSISNYLA | WYQQKPGKAPKLLIY | SASTLAS |
| Ab3.H | DIQMTQSPSTLSASVGDRVTITC | QASEDISSNLA | WYQQKPGKAPKLLIY | SASTLAS |
| Ab4.H | DIQMTQSPSTLSASVGDRVTITC | RASQSISVYLA | WYQQKPGKAPKLLIY | QASKLAS |
| Ab6.H | DIQMTQSPSTLSASVGDRVTITC | QATQSIGNNLA | WYQQKPGKAPKLLIY | RASTLAS |
| Ab7.H | DIQMTQSPSTLSASVGDRVTITC | QASQSISDYLS | WYQQKPGKAPKLLIY | RASTLAS |
| Ab7A.H | ADIQMTQSPSTLSASVGDRVTITC | QASQSISDYLS | WYQQKPGKAPKLLIY | SASTLAS |
| Ab10.H | DIQMTQSPSTLSASVGDRVTITC | QASENIYRSLA | WYQQKPGKAPKLLIY | SASTLAS |
| Ab11.H | DIQMTQSPSTLSASVGDRVTITC | QASQSIDSSLA | WYQQKPGKAPKLLIY | SASTLAS |
| Ab11A.H | DIQMTQSPSTLSASVGDRVTITC | QASQSIGSSLA | WYQQKPGKAPKLLIY | SASTLAS |
| Ab12.H | DIQMTQSPSTLSASVGDRVTITC | QASQSIGSSLA | WYQQKPGKAPKLLIY | AASTLAS |
| Ab13.H | DIQMTQSPSTLSASVGDRVTITC | QASQTISSDLA | WYQQKPGKAPKLLIY | AASKLTS |
| Ab15.H | DIQMTQSPSTLSASVGDRVTITC | QASEDIESDLA | WYQQKPGKAPKLLIY | GASTLKS |
| Ab17.H | DIQMTQSPSTLSASVGDRVTITC | QASQTISSDLA | WYQQKPGKAPKLLIY | AASKLTS |

FIG. 2B
Antibody Light chain Protein features

| Sequence Name | FR3 | CDR3 | FR4 |
|---|---|---|---|
| Ab13 | GVSSRFKGGGTGTQFTLTISDLECADAATYYC | QTYYDIIDDGCT | FGGGTEVVVKR |
| Ab15 | GVSSRFRGSGSGTEYTLTISDLECADAATYYC | QTYDMADDGCS | FGGGTEVVVKR |
| Ab17 | GVSSRFKGGGTGTQFTLTISDLECADAATYYC | QTYDISDDGCT | FGGGTEVVVKR |
| Ab1.H | GVPSRFSGSGSGTEFTLTISSLQPDDFATYYC | QSYDGSSGSSYGVG | FGGGTKVEIKR |
| Ab2.H | GVPSRFSGSGSGTEFTLTISSLQPDDFATYYC | QSYEGSSSSSYGIG | FGGGTKVEIKR |
| Ab3.H | GVPSRFSGSGSGTEFTLTISSLQPDDFATYYC | QSYDGSSSSSYGVG | FGGGTKVEIKR |
| Ab4.H | GVPSRFSGSGSGTEFTLTISSLQPDDFATYYC | QSYDGSSSSSYGVG | FGGGTKVEIKR |
| Ab6.H | GVPSRFSGSGSGTEFTLTISSLQPDDFATYYC | QSYYYSSSITYHNA | FGGGTKVEIKR |
| Ab7.H | GVPSRFSGSGSGTEFTLTISSLQPDDFATYYC | QSYYYSSSITYRNA | FGGGTKVEIKR |
| Ab7A.H | GVPSRFSGSGSGTEFTLTISSLQPDDFATYYC | QSYDGSSSSSYGVG | FGGGTKVEIKR |
| Ab10.H | GVPSRFSGSGSGTEFTLTISSLQPDDFATYYC | QSYDGSSSSSYYGIG | FGGGTKVEIKR |
| Ab11.H | GVPSRFSGSGSGTEFTLTISSLQPDDFATYYC | QSYEGSSSSSYYGIG | FGGGTKVEIKR |
| Ab11A.H | GVPSRFSGSGSGTEFTLTISSLQPDDFATYYC | QSYDGSSSSSYGVG | FGGGTKVEIKR |
| Ab12.H | GVPSRFSGSGSGTEFTLTISSLQPDDFATYYC | QTYDIIDDGAT | FGGGTKVEIKR |
| Ab13.H | GVPSRFSGSGSGTEYTLTISSLQPDDFATYYC | QTYDMADDGAS | FGGGTKVEIKR |
| Ab15.H | GVPSRFSGSGSGTEFTLTISSLQPDDFATYYC | QTYDISDDGAT | FGGGTKVEIKR |
| Ab17.H | GVPSRFSGSGSGTEFTLTISSLQPDDFATYYC | QTYDISDDGAT | FGGGTKVEIKR |

FIG. 2C
Antibody Light chain Protein features

```
                              Constant region
Sequence
  Name
Ab13     TVAAPSVFIFPPSDEQLKSGTASVVCLLNNFYPREAKVQWKVDNALQSGNSQESVTEQDSKDSTYSLSSTLTLSKA
Ab15     TVAAPSVFIFPPSDEQLKSGTASVVCLLNNFYPREAKVQWKVDNALQSGNSQESVTEQDSKDSTYSLSSTLTLSKA
Ab17     TVAAPSVFIFPPSDEQLKSGTASVVCLLNNFYPREAKVQWKVDNALQSGNSQESVTEQDSKDSTYSLSSTLTLSKA
Ab1.H    TVAAPSVFIFPPSDEQLKSGTASVVCLLNNFYPREAKVQWKVDNALQSGNSQESVTEQDSKDSTYSLSSTLTLSKA
Ab2.H    TVAAPSVFIFPPSDEQLKSGTASVVCLLNNFYPREAKVQWKVDNALQSGNSQESVTEQDSKDSTYSLSSTLTLSKA
Ab3.H    TVAAPSVFIFPPSDEQLKSGTASVVCLLNNFYPREAKVQWKVDNALQSGNSQESVTEQDSKDSTYSLSSTLTLSKA
Ab4.H    TVAAPSVFIFPPSDEQLKSGTASVVCLLNNFYPREAKVQWKVDNALQSGNSQESVTEQDSKDSTYSLSSTLTLSKA
Ab6.H    TVAAPSVFIFPPSDEQLKSGTASVVCLLNNFYPREAKVQWKVDNALQSGNSQESVTEQDSKDSTYSLSSTLTLSKA
Ab7.H    TVAAPSVFIFPPSDEQLKSGTASVVCLLNNFYPREAKVQWKVDNALQSGNSQESVTEQDSKDSTYSLSSTLTLSKA
Ab7A.H   TVAAPSVFIFPPSDEQLKSGTASVVCLLNNFYPREAKVQWKVDNALQSGNSQESVTEQDSKDSTYSLSSTLTLSKA
Ab10.H   TVAAPSVFIFPPSDEQLKSGTASVVCLLNNFYPREAKVQWKVDNALQSGNSQESVTEQDSKDSTYSLSSTLTLSKA
Ab11.H   TVAAPSVFIFPPSDEQLKSGTASVVCLLNNFYPREAKVQWKVDNALQSGNSQESVTEQDSKDSTYSLSSTLTLSKA
Ab11A.H  TVAAPSVFIFPPSDEQLKSGTASVVCLLNNFYPREAKVQWKVDNALQSGNSQESVTEQDSKDSTYSLSSTLTLSKA
Ab12.H   TVAAPSVFIFPPSDEQLKSGTASVVCLLNNFYPREAKVQWKVDNALQSGNSQESVTEQDSKDSTYSLSSTLTLSKA
Ab13.H   TVAAPSVFIFPPSDEQLKSGTASVVCLLNNFYPREAKVQWKVDNALQSGNSQESVTEQDSKDSTYSLSSTLTLSKA
Ab15.H   TVAAPSVFIFPPSDEQLKSGTASVVCLLNNFYPREAKVQWKVDNALQSGNSQESVTEQDSKDSTYSLSSTLTLSKA
Ab17.H   TVAAPSVFIFPPSDEQLKSGTASVVCLLNNFYPREAKVQWKVDNALQSGNSQESVTEQDSKDSTYSLSSTLTLSKA
```

FIG. 2D
Antibody Light chain Protein features

| Sequence Name | Constant region |
|---|---|
| Ab13 | DYEKHKVYACEVTHQGLSSPVTKSFNRGEC (SEQ ID NO:21) |
| Ab15 | DYEKHKVYACEVTHQGLSSPVTKSFNRGEC (SEQ ID NO:61) |
| Ab17 | DYEKHKVYACEVTHQGLSSPVTKSFNRGEC (SEQ ID NO:101) |
| Ab1.H | DYEKHKVYACEVTHQGLSSPVTKSFNRGEC (SEQ ID NO:141) |
| Ab2.H | DYEKHKVYACEVTHQGLSSPVTKSFNRGEC (SEQ ID NO:181) |
| Ab3.H | DYEKHKVYACEVTHQGLSSPVTKSFNRGEC (SEQ ID NO:221) |
| Ab4.H | DYEKHKVYACEVTHQGLSSPVTKSFNRGEC (SEQ ID NO:261) |
| Ab6.H | DYEKHKVYACEVTHQGLSSPVTKSFNRGEC (SEQ ID NO:301) |
| Ab7.H | DYEKHKVYACEVTHQGLSSPVTKSFNRGEC (SEQ ID NO:341) |
| Ab7A.H | DYEKHKVYACEVTHQGLSSPVTKSFNRGEC (SEQ ID NO:381) |
| Ab10.H | DYEKHKVYACEVTHQGLSSPVTKSFNRGEC (SEQ ID NO:421) |
| Ab11.H | DYEKHKVYACEVTHQGLSSPVTKSFNRGEC (SEQ ID NO:461) |
| Ab11A.H | DYEKHKVYACEVTHQGLSSPVTKSFNRGEC (SEQ ID NO:501) |
| Ab12.H | DYEKHKVYACEVTHQGLSSPVTKSFNRGEC (SEQ ID NO:541) |
| Ab13.H | DYEKHKVYACEVTHQGLSSPVTKSFNRGEC (SEQ ID NO:581) |
| Ab15.H | DYEKHKVYACEVTHQGLSSPVTKSFNRGEC (SEQ ID NO:621) |
| Ab17.H | DYEKHKVYACEVTHQGLSSPVTKSFNRGEC (SEQ ID NO:661) |

FIG. 3A
Antibody Heavy chain DNA features

| Sequence Name | FR1 |
|---|---|
| Ab13 | cagcagctggaggagtccggggggaggcctggtcaagcctggagggtcactgacactcacctgcacagcctctggat |
| Ab15 | cagcagcaactggaagagtccggggggaggcctagtcaagcctcaagactcacctgacactcacctgtaaaggctctg |
| Ab17 | cagcagcagctggaggagtccggggggaggcctggcctaagcctcaagactcacctgacactcacctgcaaagcctctg |
| Ab1.H | gaggtgcagcttgtggagtctgggggaggcttggtccagcctggggggtccctgagactctcctgtgcagcctctg |
| Ab2.H | gaggtgcagcttgtggagtctgggggaggcttggtccagcctggggggtccctgagactctcctgtgcagcctctg |
| Ab3.H | gaggtgcagcttgtggagtctgggggaggcttggtccagcctggggggtccctgagactctcctgtgcagcctctg |
| Ab4.H | gaggtgcagcttgtggagtctgggggaggcttggtccagcctggggggtccctgagactctcctgtgcagcctctg |
| Ab6.H | gaggtgcagcttgtggagtctgggggaggcttggtccagcctggggggtccctgagactctcctgtgcagcctctg |
| Ab7.H | gaggtgcagcttgtggagtctgggggaggcttggtccagcctggggggtccctgagactctcctgtgcagcctctg |
| Ab7A.H | gaggtgcagcttgtggagtctgggggaggcttggtccagcctggggggtccctgagactctcctgtgcagcctctg |
| Ab10.H | gaggtgcagcttgtggagtctgggggaggcttggtccagcctggggggtccctgagactctcctgtgcagcctctg |
| Ab11.H | gaggtgcagcttgtggagtctgggggaggcttggtccagcctggggggtccctgagactctcctgtgcagcctctg |
| Ab11A.H | gaggtgcagcttgtggagtctgggggaggcttggtccagcctggggggtccctgagactctcctgtgcagcctctg |
| Ab12.H | gaggtgcagcttgtggagtctgggggaggcttggtccagcctggggggtccctgagactctcctgtgcagcctctg |
| Ab13.H | gaggtgcagcttgtggagtctgggggaggcttggtccagcctggggggtccctgagactctcctgtgcagcctctg |
| Ab15.H | cagcagcagcttgtggagtctgggggaggcttggtccagcctggggggtccctgagactctcctgtgcagcctctg |
| Ab17.H | cagcagcagcttgtggagtctgggggaggcttggtccagcctggggggtccctgagactctcctgtgcagcctctg |

FIG. 3B
Antibody Heavy chain DNA features

| Sequence Name | FR1 | CDR1 | FR2 |
|---|---|---|---|
| Ab13 | tctccttcagt | agcggctacgacatctgc | tgggcccgccaggtccaggggaaggggctggagtggatcgga |
| Ab15 | gaattgccttcagt | gacacctacgacatgtgc | tgggtccgccaggctccaggggaaggggctggaatggatcgga |
| Ab17 | gattctccttcagt | agcggctacgacatctgc | tgggcccgccaggtccaggggaaggggctggagtggatcgga |
| Ab1.H | gattcaccgtcagt | aactatgacatgatc | tgggtccgtcaggctccagggaaggggctggagtccatcgga |
| Ab2.H | gattcaccgtcagt | aagtatgacatgatc | tgggtccgtcaggctccagggaaggggctggagtccatcgga |
| Ab3.H | gttcctcctcagt | aactttgacatgagt | tgggtccgtcaggctccagggaaggggctggagtccatcgga |
| Ab4.H | gattcaccgtcagt | aagcatgacatgatc | tgggtccgtcaggctccagggaaggggctggagtccatcgga |
| Ab6.H | gattctcctcact | gactatgcaatgagc | tgggtccgtcaggctccagggaaggggctggagtggatcgga |
| Ab7.H | gattctcctcagt | agctatgcaatgagc | tgggtccgtcaggctccagggaaggggctggagtggatcgga |
| Ab7A.H | gattctcctcagt | agcgctgacatgatc | tgggtccgtcaggctccagggaaggggctggagtggatcgga |
| Ab10.H | gattcaccgtcagt | agcgctgacatgagc | tgggtccgtcaggctccagggaaggggctggagtccatcgga |
| Ab11.H | gattcaccgtcagt | gcctatgacatcctc | tgggtccgtcaggctccagggaaggggctggagtccatcgga |
| Ab11A.H | gattcaccgtcagt | gcctatgacatcctc | tgggtccgtcaggctccagggaaggggctggagtccatcgga |
| Ab12.H | gatcctcctcagt | gattatgacatgatc | tgggtccgtcaggctccagggaaggggctggagtccatcgga |
| Ab13.H | gattcaccgtcagt | agcggctacgacatctgc | tgggtccgtcaggctccagggaaggggctggagtggatcgga |
| Ab15.H | gattcaccgtcagt | gacacctacgacatgtgc | tgggtccgtcaggctccagggaaggggctggagtggatcgga |
| Ab17.H | gattcaccgtcagt | agcggctacgacatctgc | tgggtccgtcaggctccagggaaggggctggagtggatcgga |

FIG. 3C
Antibody Heavy chain DNA features

| Sequence Name | CDR2 | FR3 |
|---|---|---|
| Ab13 | tgcattgatatactggtagtggtaacacttactacgcgagctgggcgaaaggc | cgattcaccatgtccagaacctcgt |
| Ab15 | tgcatcgatactggtagtggtagtggtgacacttactacccgacctgggcgaaaggc | cgattcaccatctccaaacctcgt |
| Ab17 | tgcattgatactggtagtggtagtggtgacacttactacgcgagctgggcgaaaggc | cgattcaccatctccagaacctcgt |
| Ab1.H | atgattatgatgatggtgacacatactacgctagttctgctaaaggc | cgattcaccatctccagagacaatt |
| Ab2.H | atcatttatgatgatggcgacacatattacgctagttctgctaaaggc | cgattcaccatctccagagacaatt |
| Ab3.H | atcatttatgattttggtgacacatactacgccagctctgctaaaggc | cgattcaccatctccagagacaatt |
| Ab4.H | atcatttatgatgatggtgatacatactacgctaattctgctaaaggc | cgattcaccatctccagagacaatt |
| Ab6.H | atcattagtgatagtggtgacacatactacgctagctctgctaaaggc | cgattcaccatctccagagacaatt |
| Ab7.H | atcattagtgatagtggtagcacatactacgcgagctctgctaaaggc | cgattcaccatctccagagacaatt |
| Ab7A.H | atcattagtgatagtggtagcacatactacgcgagctctgctaaaggc | cgattcaccatctccagagacaatt |
| Ab10.H | atgatttatgatgatggtgacacatactacgctactttctgctaaaggc | cgattcaccatctccagagacaatt |
| Ab11.H | atgatgtatgatgatggtgacacatactacgctactttctgctaaaggc | cgattcaccatctccagagacaatt |
| Ab11A.H | atgatgtatgatgatggtgacacatactacgctactttctgctaaaggc | cgattcaccatctccagagacaatt |
| Ab12.H | atcatttatgatgatggtgacacatactacgctactttctgctaaaggc | cgattcaccatctccagagacaatt |
| Ab13.H | tgcattgatactggtagtggtagtggtaacacttactacgctagctctgctaaaggc | cgattcaccatgtccagagacaatt |
| Ab15.H | tgcatcgatactggtagtggtagtggtgacacttactaccaacctctgctaaaggc | cgattcaccatctccagagacaatt |
| Ab17.H | tgcattgatactggtagtggtagtggtaacacttactacgccagctctgcaaaaggc | cgattcaccatctccagagacaatt |

FIG. 3D
Antibody Heavy chain DNA features

| Sequence Name | FR3 |
|---|---|
| Ab13 | cgaccacggtgactctgcaagtgaccagtctgacagccgcgacacggccacctatttctgtgcgaag |
| Ab15 | cgaccacggtggatctgaaaatgaccagtctgacagccgcgacacggccacatatttctgtgcgaag |
| Ab17 | cgaccacgcgtgactctgcaaatgaccagtctgacagccgcgacacggccacctatttctgtgcgaag |
| Ab1.H | ccaagaacacccctgtatcttcaaatgaacagcctgagagcctgaggacactgctgtgtattactgtgtcaaa |
| Ab2.H | ccaagaacacccctgtatcttcaaatgaacagcctgagagcctgaggacactgctgtgtattactgtgtcaaa |
| Ab3.H | ccaagaacacccctgtatcttcaaatgaacagcctgagagcctgaggacactgctgtgtattactgtgtcaaa |
| Ab4.H | ccaagaacacccctgtatcttcaaatgaacagcctgagagcctgaggacactgctgtgtattactgtgtcaaa |
| Ab6.H | ccaagaacacccctgtatcttcaaatgaacagcctgagagcctgaggacactgctgtgtattactgtgtcaaa |
| Ab7.H | ccaagaacacccctgtatcttcaaatgaacagcctgagagcctgaggacactgctgtgtattactgtgctaga |
| Ab7A.H | ccaagaacacccctgtatcttcaaatgaacagcctgagagcctgaggacactgctgtgtattactgtgctaga |
| Ab10.H | ccaagaacacccctgtatcttcaaatgaacagcctgagagcctgaggacactgctgtgtattactgtgtcaaa |
| Ab11.H | ccaagaacacccctgtatcttcaaatgaacagcctgagagcctgaggacactgctgtgtattactgtgtcaaa |
| Ab11A.H | ccaagaacacccctgtatcttcaaatgaacagcctgagagcctgaggacactgctgtgtattactgtgtcaaa |
| Ab12.H | ccaagaacacccctgtatcttcaaatgaacagcctgagagcctgaggacactgctgtgtattactgtgtcaaa |
| Ab13.H | ccaagaacacccgtgtatcttcaaatgaacagcctgagagcctgaggacactgctgtgtattactgtgctaag |
| Ab15.H | ccaagaacacccctgtatcttcaaatgaacagcctgagagcctgaggacactgctgtgtattactgtgctaag |
| Ab17.H | ccaagaacacccctgtatcttcaaatgaacagcctgagagcctgaggacactgctgtgtattactgtgctaag |

FIG. 3E
Antibody Heavy chain DNA features

| Sequence Name | CDR3 | FR4 |
|---|---|---|
| Ab13 | ggtatttctagtata | tggggcccggggaccggcacccgtggtcaccgtct |
| Ab15 | ggtgtttccagttta | tggggccaagggaccctcgtcaccgtct |
| Ab17 | ggtatttctagttta | tggggcccggccaccctcgtcaccgtct |
| Ab1.H | ggtgtgagtaatcac | tggggccaagggaccctcgtcaccgtct |
| Ab2.H | ggtgtgagtaatatc | tggggccaagggaccctcgtcaccgtct |
| Ab3.H | ggtgtgagtaatatc | tggggccaagggaccctcgtcaccgtct |
| Ab4.H | ggtgtgagtaatatc | tggggccaagggaccctcgtcaccgtct |
| Ab6.H | gagcccgagtacggctacgatgagtgattggtgattgggtttctgactta | tggggccaagggaccctcgtcaccgtct |
| Ab7.H | gagcccgagtacggctacgatgactactatgattggtgattgggtttctgactta | tggggccaagggaccctcgtcaccgtct |
| Ab7A.H | gagcccgagtacggctacgatgactactatgattggtgattgggtttctgactta | tggggccaagggaccctcgtcaccgtct |
| Ab10.H | ggtgtgagtagtgtc | tggggccaagggaccctcgtcaccgtct |
| Ab11.H | ggtgtgagtaatatc | tggggccaagggaccctcgtcaccgtct |
| Ab11A.H | ggtgtgagtaatatc | tggggccaagggaccctcgtcaccgtct |
| Ab12.H | ggtgtgagtaatatg | tggggccaagggaccctcgtcaccgtct |
| Ab13.H | ggtatttctagtata | tggggccaagggaccctcgtcaccgtct |
| Ab15.H | ggtgtttccagttta | tggggccaagggaccctcgtcaccgtct |
| Ab17.H | ggtatttctagttta | tggggccaagggaccctcgtcaccgtct |

FIG. 3F
Antibody Heavy chain DNA features

| Sequence Name | FR4 | Constant region |
|---|---|---|
| Ab13 | cgagc | gcctccaccaagggcccatcggtcttccccctggcaccctcctccaagagcacctctgggggcacagcgg |
| Ab15 | cgagc | gcctccaccaagggcccatcggtcttccccctggcaccctcctccaagagcacctctgggggcacagcgg |
| Ab17 | cgagc | gcctccaccaagggcccatcggtcttccccctggcaccctcctccaagagcacctctgggggcacagcgg |
| Ab1.H | cgagc | gcctccaccaagggcccatcggtcttccccctggcaccctcctccaagagcacctctgggggcacagcgg |
| Ab2.H | cgagc | gcctccaccaagggcccatcggtcttccccctggcaccctcctccaagagcacctctgggggcacagcgg |
| Ab3.H | cgagc | gcctccaccaagggcccatcggtcttccccctggcaccctcctccaagagcacctctgggggcacagcgg |
| Ab4.H | cgagc | gcctccaccaagggcccatcggtcttccccctggcaccctcctccaagagcacctctgggggcacagcgg |
| Ab6.H | cgagc | gcctccaccaagggcccatcggtcttccccctggcaccctcctccaagagcacctctgggggcacagcgg |
| Ab7.H | cgagc | gcctccaccaagggcccatcggtcttccccctggcaccctcctccaagagcacctctgggggcacagcgg |
| Ab7A.H | cgagc | gcctccaccaagggcccatcggtcttccccctggcaccctcctccaagagcacctctgggggcacagcgg |
| Ab10.H | cgagc | gcctccaccaagggcccatcggtcttccccctggcaccctcctccaagagcacctctgggggcacagcgg |
| Ab11.H | cgagc | gcctccaccaagggcccatcggtcttccccctggcaccctcctccaagagcacctctgggggcacagcgg |
| Ab11A.H | cgagc | gcctccaccaagggcccatcggtcttccccctggcaccctcctccaagagcacctctgggggcacagcgg |
| Ab12.H | cgagc | gcctccaccaagggcccatcggtcttccccctggcaccctcctccaagagcacctctgggggcacagcgg |
| Ab13.H | cgagc | gcctccaccaagggcccatcggtcttccccctggcaccctcctccaagagcacctctgggggcacagcgg |
| Ab15.H | cgagc | gcctccaccaagggcccatcggtcttccccctggcaccctcctccaagagcacctctgggggcacagcgg |
| Ab17.H | cgagc | gcctccaccaagggcccatcggtcttccccctggcaccctcctccaagagcacctctgggggcacagcgg |

FIG. 3G
Antibody Heavy chain DNA features

| Sequence Name | Constant region |
|---|---|
| Ab13 | ccctgggctgcctggtcaaggactacttccccgaaccgtgacggtgtcgtggaactcaggcgccctgaccagcg |
| Ab15 | ccctgggctgcctggtcaaggactacttccccgaaccgtgacggtgtcgtggaactcaggcgccctgaccagcg |
| Ab17 | ccctgggctgcctggtcaaggactacttccccgaaccgtgacggtgtcgtggaactcaggcgccctgaccagcg |
| Ab1.H | ccctgggctgcctggtcaaggactacttccccgaaccgtgacggtgtcgtggaactcaggcgccctgaccagcg |
| Ab2.H | ccctgggctgcctggtcaaggactacttccccgaaccgtgacggtgtcgtggaactcaggcgccctgaccagcg |
| Ab3.H | ccctgggctgcctggtcaaggactacttccccgaaccgtgacggtgtcgtggaactcaggcgccctgaccagcg |
| Ab4.H | ccctgggctgcctggtcaaggactacttccccgaaccgtgacggtgtcgtggaactcaggcgccctgaccagcg |
| Ab6.H | ccctgggctgcctggtcaaggactacttccccgaaccgtgacggtgtcgtggaactcaggcgccctgaccagcg |
| Ab7.H | ccctgggctgcctggtcaaggactacttccccgaaccgtgacggtgtcgtggaactcaggcgccctgaccagcg |
| Ab7A.H | ccctgggctgcctggtcaaggactacttccccgaaccgtgacggtgtcgtggaactcaggcgccctgaccagcg |
| Ab10.H | ccctgggctgcctggtcaaggactacttccccgaaccgtgacggtgtcgtggaactcaggcgccctgaccagcg |
| Ab11.H | ccctgggctgcctggtcaaggactacttccccgaaccgtgacggtgtcgtggaactcaggcgccctgaccagcg |
| Ab11A.H | ccctgggctgcctggtcaaggactacttccccgaaccgtgacggtgtcgtggaactcaggcgccctgaccagcg |
| Ab12.H | ccctgggctgcctggtcaaggactacttccccgaaccgtgacggtgtcgtggaactcaggcgccctgaccagcg |
| Ab13.H | ccctgggctgcctggtcaaggactacttccccgaaccgtgacggtgtcgtggaactcaggcgccctgaccagcg |
| Ab15.H | ccctgggctgcctggtcaaggactacttccccgaaccgtgacggtgtcgtggaactcaggcgccctgaccagcg |
| Ab17.H | ccctgggctgcctggtcaaggactacttccccgaaccgtgacggtgtcgtggaactcaggcgccctgaccagcg |

FIG. 3H
Antibody Heavy chain DNA features

| Sequence Name | Constant region |
|---|---|
| Ab13 | gcgtgcacaccttccggctgtcctacagtcctcaggactctactcctcagcagcgtggtgaccgtgccctcca |
| Ab15 | gcgtgcacaccttccggctgtcctacagtcctcaggactctactcctcagcagcgtggtgaccgtgccctcca |
| Ab17 | gcgtgcacaccttccggctgtcctacagtcctcaggactctactcctcagcagcgtggtgaccgtgccctcca |
| Ab1.H | gcgtgcacaccttccggctgtcctacagtcctcaggactctactcctcagcagcgtggtgaccgtgccctcca |
| Ab2.H | gcgtgcacaccttccggctgtcctacagtcctcaggactctactcctcagcagcgtggtgaccgtgccctcca |
| Ab3.H | gcgtgcacaccttccggctgtcctacagtcctcaggactctactcctcagcagcgtggtgaccgtgccctcca |
| Ab4.H | gcgtgcacaccttccggctgtcctacagtcctcaggactctactcctcagcagcgtggtgaccgtgccctcca |
| Ab6.H | gcgtgcacaccttccggctgtcctacagtcctcaggactctactcctcagcagcgtggtgaccgtgccctcca |
| Ab7.H | gcgtgcacaccttccggctgtcctacagtcctcaggactctactcctcagcagcgtggtgaccgtgccctcca |
| Ab7A.H | gcgtgcacaccttccggctgtcctacagtcctcaggactctactcctcagcagcgtggtgaccgtgccctcca |
| Ab10.H | gcgtgcacaccttccggctgtcctacagtcctcaggactctactcctcagcagcgtggtgaccgtgccctcca |
| Ab11.H | gcgtgcacaccttccggctgtcctacagtcctcaggactctactcctcagcagcgtggtgaccgtgccctcca |
| Ab11A.H | gcgtgcacaccttccggctgtcctacagtcctcaggactctactcctcagcagcgtggtgaccgtgccctcca |
| Ab12.H | gcgtgcacaccttccggctgtcctacagtcctcaggactctactcctcagcagcgtggtgaccgtgccctcca |
| Ab13.H | gcgtgcacaccttccggctgtcctacagtcctcaggactctactcctcagcagcgtggtgaccgtgccctcca |
| Ab15.H | gcgtgcacaccttccggctgtcctacagtcctcaggactctactcctcagcagcgtggtgaccgtgccctcca |
| Ab17.H | gcgtgcacaccttccggctgtcctacagtcctcaggactctactcctcagcagcgtggtgaccgtgccctcca |

FIG. 3I
Antibody Heavy chain DNA features

| Sequence Name | Constant region |
|---|---|
| Ab13 | gcagcttgggcacccagacctacatctgcaacgtgaatcacaagcccagcaacaccaacaccaaggtggacgcgagagttg |
| Ab15 | gcagcttgggcacccagacctacatctgcaacgtgaatcacaagcccagcaacaccaacaccaaggtggacgcgagagttg |
| Ab17 | gcagcttgggcacccagacctacatctgcaacgtgaatcacaagcccagcaacaccaacaccaaggtggacgcgagagttg |
| Ab1.H | gcagcttgggcacccagacctacatctgcaacgtgaatcacaagcccagcaacaccaacaccaaggtggacgcgagagttg |
| Ab2.H | gcagcttgggcacccagacctacatctgcaacgtgaatcacaagcccagcaacaccaacaccaaggtggacgcgagagttg |
| Ab3.H | gcagcttgggcacccagacctacatctgcaacgtgaatcacaagcccagcaacaccaacaccaaggtggacgcgagagttg |
| Ab4.H | gcagcttgggcacccagacctacatctgcaacgtgaatcacaagcccagcaacaccaacaccaaggtggacgcgagagttg |
| Ab6.H | gcagcttgggcacccagacctacatctgcaacgtgaatcacaagcccagcaacaccaacaccaaggtggacgcgagagttg |
| Ab7.H | gcagcttgggcacccagacctacatctgcaacgtgaatcacaagcccagcaacaccaacaccaaggtggacgcgagagttg |
| Ab7A.H | gcagcttgggcacccagacctacatctgcaacgtgaatcacaagcccagcaacaccaacaccaaggtggacgcgagagttg |
| Ab10.H | gcagcttgggcacccagacctacatctgcaacgtgaatcacaagcccagcaacaccaacaccaaggtggacgcgagagttg |
| Ab11.H | gcagcttgggcacccagacctacatctgcaacgtgaatcacaagcccagcaacaccaacaccaaggtggacgcgagagttg |
| Ab11A.H | gcagcttgggcacccagacctacatctgcaacgtgaatcacaagcccagcaacaccaacaccaaggtggacaagaaagttg |
| Ab12.H | gcagcttgggcacccagacctacatctgcaacgtgaatcacaagcccagcaacaccaacaccaaggtggacgcgagagttg |
| Ab13.H | gcagcttgggcacccagacctacatctgcaacgtgaatcacaagcccagcaacaccaacaccaaggtggacaagaaagttg |
| Ab15.H | gcagcttgggcacccagacctacatctgcaacgtgaatcacaagcccagcaacaccaacaccaaggtggacgcgagagttg |
| Ab17.H | gcagcttgggcacccagacctacatctgcaacgtgaatcacaagcccagcaacaccaacaccaaggtggacgcgagagttg |

FIG. 3J
Antibody Heavy chain DNA features

| Sequence Name | Constant region |
|---|---|
| Ab13 | agcccaaatcttgtgacaaaactcacacatgcccaccgtgcccagcacctgaactcctggggggaccgtcagtct |
| Ab15 | agcccaaatcttgtgacaaaactcacacatgcccaccgtgcccagcacctgaactcctggggggaccgtcagtct |
| Ab17 | agcccaaatcttgtgacaaaactcacacatgcccaccgtgcccagcacctgaactcctggggggaccgtcagtct |
| Ab1.H | agcccaaatcttgtgacaaaactcacacatgcccaccgtgcccagcacctgaactcctggggggaccgtcagtct |
| Ab2.H | agcccaaatcttgtgacaaaactcacacatgcccaccgtgcccagcacctgaactcctggggggaccgtcagtct |
| Ab3.H | agcccaaatcttgtgacaaaactcacacatgcccaccgtgcccagcacctgaactcctggggggaccgtcagtct |
| Ab4.H | agcccaaatcttgtgacaaaactcacacatgcccaccgtgcccagcacctgaactcctggggggaccgtcagtct |
| Ab6.H | agcccaaatcttgtgacaaaactcacacatgcccaccgtgcccagcacctgaactcctggggggaccgtcagtct |
| Ab7.H | agcccaaatcttgtgacaaaactcacacatgcccaccgtgcccagcacctgaactcctggggggaccgtcagtct |
| Ab7A.H | agcccaaatcttgtgacaaaactcacacatgcccaccgtgcccagcacctgaactcctggggggaccgtcagtct |
| Ab10.H | agcccaaatcttgtgacaaaactcacacatgcccaccgtgcccagcacctgaactcctggggggaccgtcagtct |
| Ab11.H | agcccaaatcttgtgacaaaactcacacatgcccaccgtgcccagcacctgaactcctggggggaccgtcagtct |
| Ab11A.H | agcccaaatcttgtgacaaaactcacacatgcccaccgtgcccagcacctgaactcctggggggaccgtcagtct |
| Ab12.H | agcccaaatcttgtgacaaaactcacacatgcccaccgtgcccagcacctgaactcctggggggaccgtcagtct |
| Ab13.H | agcccaaatcttgtgacaaaactcacacatgcccaccgtgcccagcacctgaactcctggggggaccgtcagtct |
| Ab15.H | agcccaaatcttgtgacaaaactcacacatgcccaccgtgcccagcacctgaactcctggggggaccgtcagtct |
| Ab17.H | agcccaaatcttgtgacaaaactcacacatgcccaccgtgcccagcacctgaactcctggggggaccgtcagtct |

FIG. 3K
Antibody Heavy chain DNA features

| Sequence Name | Constant region |
|---|---|
| Ab13 | tcctcttcccccaaaacccaaggacaccctcatgatctccggacccctgaggtcacatgcgtggtggtggacg |
| Ab15 | tcctcttcccccaaaacccaaggacaccctcatgatctccggacccctgaggtcacatgcgtggtggtggacg |
| Ab17 | tcctcttcccccaaaacccaaggacaccctcatgatctccggacccctgaggtcacatgcgtggtggtggacg |
| Ab1.H | tcctcttccccccaaaacccaaggacaccctcatgatctccggacccctgaggtcacatgcgtggtggtggacg |
| Ab2.H | tcctcttccccccaaaacccaaggacaccctcatgatctccggacccctgaggtcacatgcgtggtgtggacg |
| Ab3.H | tcctcttccccccaaaacccaaggacaccctcatgatctccggacccctgaggtcacatgcgtggtggtggacg |
| Ab4.H | tcctcttccccccaaaacccaaggacaccctcatgatctccggacccctgaggtcacatgcgtggtggtggacg |
| Ab6.H | tcctcttccccccaaaacccaaggacaccctcatgatctccggacccctgaggtcacatgcgtggtggtggacg |
| Ab7.H | tcctcttccccccaaaacccaaggacaccctcatgatctccggacccctgaggtcacatgcgtggtggtggacg |
| Ab7A.H | tcctcttccccccaaaacccaaggacaccctcatgatctccggacccctgaggtcacatgcgtggtggtggacg |
| Ab10.H | tcctcttccccccaaaacccaaggacaccctcatgatctccggacccctgaggtcacatgcgtggtggtggacg |
| Ab11.H | tcctcttccccccaaaacccaaggacaccctcatgatctccggacccctgaggtcacatgcgtggtgtggacg |
| Ab11A.H | tcctcttccccccaaaacccaaggacaccctcatgatctccggacccctgaggtcacatgcgtggtggtggacg |
| Ab12.H | tcctcttccccccaaaacccaaggacaccctcatgatctccggacccctgaggtcacatgcgtggtggtggacg |
| Ab13.H | tcctcttccccccaaaacccaaggacaccctcatgatctccggacccctgaggtcacatgcgtggtggtggacg |
| Ab15.H | tcctcttccccccaaaacccaaggacaccctcatgatctccggacccctgaggtcacatgcgtggtggtggacg |
| Ab17.H | tcctcttccccccaaaacccaaggacaccctcatgatctccggacccctgaggtcacatgcgtggtggtggacg |

FIG. 3L
Antibody Heavy chain DNA features

| Sequence Name | Constant region |
|---|---|
| Ab13 | tgagccacgaagaccctgaggtcaagttcaactggtacgtggacggcgtggaggtgcataatgccaagacaaagc |
| Ab15 | tgagccacgaagaccctgaggtcaagttcaactggtacgtggacggcgtggaggtgcataatgccaagacaaagc |
| Ab17 | tgagccacgaagaccctgaggtcaagttcaactggtacgtggacggcgtggaggtgcataatgccaagacaaagc |
| Ab1.H | tgagccacgaagaccctgaggtcaagttcaactggtacgtggacggcgtggaggtgcataatgccaagacaaagc |
| Ab2.H | tgagccacgaagaccctgaggtcaagttcaactggtacgtggacggcgtggaggtgcataatgccaagacaaagc |
| Ab3.H | tgagccacgaagaccctgaggtcaagttcaactggtacgtggacggcgtggaggtgcataatgccaagacaaagc |
| Ab4.H | tgagccacgaagaccctgaggtcaagttcaactggtacgtggacggcgtggaggtgcataatgccaagacaaagc |
| Ab6.H | tgagccacgaagaccctgaggtcaagttcaactggtacgtggacggcgtggaggtgcataatgccaagacaaagc |
| Ab7.H | tgagccacgaagaccctgaggtcaagttcaactggtacgtggacggcgtggaggtgcataatgccaagacaaagc |
| Ab7A.H | tgagccacgaagaccctgaggtcaagttcaactggtacgtggacggcgtggaggtgcataatgccaagacaaagc |
| Ab10.H | tgagccacgaagaccctgaggtcaagttcaactggtacgtggacggcgtggaggtgcataatgccaagacaaagc |
| Ab11.H | tgagccacgaagaccctgaggtcaagttcaactggtacgtggacggcgtggaggtgcataatgccaagacaaagc |
| Ab11A.H | tgagccacgaagaccctgaggtcaagttcaactggtacgtggacggcgtggaggtgcataatgccaagacaaagc |
| Ab12.H | tgagccacgaagaccctgaggtcaagttcaactggtacgtggacggcgtggaggtgcataatgccaagacaaagc |
| Ab13.H | tgagccacgaagaccctgaggtcaagttcaactggtacgtggacggcgtggaggtgcataatgccaagacaaagc |
| Ab15.H | tgagccacgaagaccctgaggtcaagttcaactggtacgtggacggcgtggaggtgcataatgccaagacaaagc |
| Ab17.H | tgagccacgaagaccctgaggtcaagttcaactggtacgtggacggcgtggaggtgcataatgccaagacaaagc |

FIG. 3M
Antibody Heavy chain DNA features

| Sequence Name | Constant region |
|---|---|
| Ab13 | cgcggggaggagcagtacgccagcacgtaccgtgtggtcagcgtcctcaccgtcctgcaccaggactggctgaatg |
| Ab15 | cgcggggaggagcagtacgccagcacgtaccgtgtggtcagcgtcctcaccgtcctgcaccaggactggctgaatg |
| Ab17 | cgcggggaggagcagtacgccagcacgtaccgtgtggtcagcgtcctcaccgtcctgcaccaggactggctgaatg |
| Ab1.H | cgcggggaggagcagtacgccagcacgtaccgtgtggtcagcgtcctcaccgtcctgcaccaggactggctgaatg |
| Ab2.H | cgcggggaggagcagtacgccagcacgtaccgtgtggtcagcgtcctcaccgtcctgcaccaggactggctgaatg |
| Ab3.H | cgcggggaggagcagtacgccagcacgtaccgtgtggtcagcgtcctcaccgtcctgcaccaggactggctgaatg |
| Ab4.H | cgcggggaggagcagtacgccagcacgtaccgtgtggtcagcgtcctcaccgtcctgcaccaggactggctgaatg |
| Ab6.H | cgcggggaggagcagtacgccagcacgtaccgtgtggtcagcgtcctcaccgtcctgcaccaggactggctgaatg |
| Ab7.H | cgcggggaggagcagtacgccagcacgtaccgtgtggtcagcgtcctcaccgtcctgcaccaggactggctgaatg |
| Ab7A.H | cgcggggaggagcagtacgccagcacgtaccgtgtggtcagcgtcctcaccgtcctgcaccaggactggctgaatg |
| Ab10.H | cgcggggaggagcagtacgccagcacgtaccgtgtggtcagcgtcctcaccgtcctgcaccaggactggctgaatg |
| Ab11.H | cgcggggaggagcagtacgccagcacgtaccgtgtggtcagcgtcctcaccgtcctgcaccaggactggctgaatg |
| Ab11A.H | cgcggggaggagcagtacgccagcacgtaccgtgtggtcagcgtcctcaccgtcctgcaccaggactggctgaatg |
| Ab12.H | cgcggggaggagcagtacgccagcacgtaccgtgtggtcagcgtcctcaccgtcctgcaccaggactggctgaatg |
| Ab13.H | cgcggggaggagcagtacgccagcacgtaccgtgtggtcagcgtcctcaccgtcctgcaccaggactggctgaatg |
| Ab15.H | cgcggggaggagcagtacgccagcacgtaccgtgtggtcagcgtcctcaccgtcctgcaccaggactggctgaatg |
| Ab17.H | cgcggggaggagcagtacgccagcacgtaccgtgtggtcagcgtcctcaccgtcctgcaccaggactggctgaatg |

FIG. 3N
Antibody Heavy chain DNA features

| Sequence Name | Constant region |
|---|---|
| Ab13 | gcaaggagtacaagtgcaaggtctccaacaaagccctcccagcccatcgagaaaaccatctccaaagccaaag |
| Ab15 | gcaaggagtacaagtgcaaggtctccaacaaagccctcccagcccatcgagaaaaccatctccaaagccaaag |
| Ab17 | gcaaggagtacaagtgcaaggtctccaacaaagccctcccagcccatcgagaaaaccatctccaaagccaaag |
| Ab1.H | gcaaggagtacaagtgcaaggtctccaacaaagccctcccagcccatcgagaaaaccatctccaaagccaaag |
| Ab2.H | gcaaggagtacaagtgcaaggtctccaacaaagccctcccagcccatcgagaaaaccatctccaaagccaaag |
| Ab3.H | gcaaggagtacaagtgcaaggtctccaacaaagccctcccagcccatcgagaaaaccatctccaaagccaaag |
| Ab4.H | gcaaggagtacaagtgcaaggtctccaacaaagccctcccagcccatcgagaaaaccatctccaaagccaaag |
| Ab6.H | gcaaggagtacaagtgcaaggtctccaacaaagccctcccagcccatcgagaaaaccatctccaaagccaaag |
| Ab7.H | gcaaggagtacaagtgcaaggtctccaacaaagccctcccagcccatcgagaaaaccatctccaaagccaaag |
| Ab7A.H | gcaaggagtacaagtgcaaggtctccaacaaagccctcccagcccatcgagaaaaccatctccaaagccaaag |
| Ab10.H | gcaaggagtacaagtgcaaggtctccaacaaagccctcccagcccatcgagaaaaccatctccaaagccaaag |
| Ab11.H | gcaaggagtacaagtgcaaggtctccaacaaagccctcccagcccatcgagaaaaccatctccaaagccaaag |
| Ab11A.H | gcaaggagtacaagtgcaaggtctccaacaaagccctcccagcccatcgagaaaaccatctccaaagccaaag |
| Ab12.H | gcaaggagtacaagtgcaaggtctccaacaaagccctcccagcccatcgagaaaaccatctccaaagccaaag |
| Ab13.H | gcaaggagtacaagtgcaaggtctccaacaaagccctcccagcccatcgagaaaaccatctccaaagccaaag |
| Ab15.H | gcaaggagtacaagtgcaaggtctccaacaaagccctcccagcccatcgagaaaaccatctccaaagccaaag |
| Ab17.H | gcaaggagtacaagtgcaaggtctccaacaaagccctcccagcccatcgagaaaaccatctccaaagccaaag |

FIG. 30
Antibody Heavy chain DNA features

| Sequence Name | Constant region |
|---|---|
| Ab13 | ggcagcccgagaaccacaggtgtacaccctgcccccatcccggaggagatgaccaagaaccaggtcagcctga |
| Ab15 | ggcagcccgagaaccacaggtgtacaccctgcccccatcccggaggagatgaccaagaaccaggtcagcctga |
| Ab17 | ggcagcccgagaaccacaggtgtacaccctgcccccatcccggaggagatgaccaagaaccaggtcagcctga |
| Ab1.H | ggcagcccgagaaccacaggtgtacaccctgcccccatcccggaggagatgaccaagaaccaggtcagcctga |
| Ab2.H | ggcagcccgagaaccacaggtgtacaccctgcccccatcccggaggagatgaccaagaaccaggtcagcctga |
| Ab3.H | ggcagcccgagaaccacaggtgtacaccctgcccccatcccggaggagatgaccaagaaccaggtcagcctga |
| Ab4.H | ggcagcccgagaaccacaggtgtacaccctgcccccatcccggaggagatgaccaagaaccaggtcagcctga |
| Ab6.H | ggcagcccgagaaccacaggtgtacaccctgcccccatcccggaggagatgaccaagaaccaggtcagcctga |
| Ab7.H | ggcagcccgagaaccacaggtgtacaccctgcccccatcccggaggagatgaccaagaaccaggtcagcctga |
| Ab7A.H | ggcagcccgagaaccacaggtgtacaccctgcccccatcccggaggagatgaccaagaaccaggtcagcctga |
| Ab10.H | ggcagcccgagaaccacaggtgtacaccctgcccccatcccggaggagatgaccaagaaccaggtcagcctga |
| Ab11.H | ggcagcccgagaaccacaggtgtacaccctgcccccatcccggaggagatgaccaagaaccaggtcagcctga |
| Ab11A.H | ggcagcccgagaaccacaggtgtacaccctgcccccatcccggaggagatgaccaagaaccaggtcagcctga |
| Ab12.H | ggcagcccgagaaccacaggtgtacaccctgcccccatcccggaggagatgaccaagaaccaggtcagcctga |
| Ab13.H | ggcagcccgagaaccacaggtgtacaccctgcccccatcccggaggagatgaccaagaaccaggtcagcctga |
| Ab15.H | ggcagcccgagaaccacaggtgtacaccctgcccccatcccggaggagatgaccaagaaccaggtcagcctga |
| Ab17.H | ggcagcccgagaaccacaggtgtacaccctgcccccatcccggaggagatgaccaagaaccaggtcagcctga |

FIG. 3P
Antibody Heavy chain DNA features

| Sequence Name | Constant region |
|---|---|
| Ab13 | cctgcctggtcaaaggcttctatcccagcgacatcgccgtggagtgggagagcaatgggcagccggagaacaact |
| Ab15 | cctgcctggtcaaaggcttctatcccagcgacatcgccgtggagtgggagagcaatgggcagccggagaacaact |
| Ab17 | cctgcctggtcaaaggcttctatcccagcgacatcgccgtggagtgggagagcaatgggcagccggagaacaact |
| Ab1.H | cctgcctggtcaaaggcttctatcccagcgacatcgccgtggagtgggagagcaatgggcagccggagaacaact |
| Ab2.H | cctgcctggtcaaaggcttctatcccagcgacatcgccgtggagtgggagagcaatgggcagccggagaacaact |
| Ab3.H | cctgcctggtcaaaggcttctatcccagcgacatcgccgtggagtgggagagcaatgggcagccggagaacaact |
| Ab4.H | cctgcctggtcaaaggcttctatcccagcgacatcgccgtggagtgggagagcaatgggcagccggagaacaact |
| Ab6.H | cctgcctggtcaaaggcttctatcccagcgacatcgccgtggagtgggagagcaatgggcagccggagaacaact |
| Ab7.H | cctgcctggtcaaaggcttctatcccagcgacatcgccgtggagtgggagagcaatgggcagccggagaacaact |
| Ab7A.H | cctgcctggtcaaaggcttctatcccagcgacatcgccgtggagtgggagagcaatgggcagccggagaacaact |
| Ab10.H | cctgcctggtcaaaggcttctatcccagcgacatcgccgtggagtgggagagcaatgggcagccggagaacaact |
| Ab11.H | cctgcctggtcaaaggcttctatcccagcgacatcgccgtggagtgggagagcaatgggcagccggagaacaact |
| Ab11A.H | cctgcctggtcaaaggcttctatcccagcgacatcgccgtggagtgggagagcaatgggcagccggagaacaact |
| Ab12.H | cctgcctggtcaaaggcttctatcccagcgacatcgccgtggagtgggagagcaatgggcagccggagaacaact |
| Ab13.H | cctgcctggtcaaaggcttctatcccagcgacatcgccgtggagtgggagagcaatgggcagccggagaacaact |
| Ab15.H | cctgcctggtcaaaggcttctatcccagcgacatcgccgtggagtgggagagcaatgggcagccggagaacaact |
| Ab17.H | cctgcctggtcaaaggcttctatcccagcgacatcgccgtggagtgggagagcaatgggcagccggagaacaact |

FIG. 3Q
Antibody Heavy chain DNA features

| Sequence Name | Constant region |
|---|---|
| Ab13 | acaagaccacgcctcccgtgctgactccgacggctcctcttcctctacagcaagctcaccgtggacaagagca |
| Ab15 | acaagaccacgcctcccgtgctgactccgacggctcctcttcctctacagcaagctcaccgtggacaagagca |
| Ab17 | acaagaccacgcctcccgtgctgactccgacggctcctcttcctctacagcaagctcaccgtggacaagagca |
| Ab1.H | acaagaccacgcctcccgtgctgactccgacggctcctcttcctctacagcaagctcaccgtggacaagagca |
| Ab2.H | acaagaccacgcctcccgtgctgactccgacggctcctcttcctctacagcaagctcaccgtggacaagagca |
| Ab3.H | acaagaccacgcctcccgtgctgactccgacggctcctcttcctctacagcaagctcaccgtggacaagagca |
| Ab4.H | acaagaccacgcctcccgtgctgactccgacggctcctcttcctctacagcaagctcaccgtggacaagagca |
| Ab6.H | acaagaccacgcctcccgtgctgactccgacggctcctcttcctctacagcaagctcaccgtggacaagagca |
| Ab7.H | acaagaccacgcctcccgtgctgactccgacggctcctcttcctctacagcaagctcaccgtggacaagagca |
| Ab7A.H | acaagaccacgcctcccgtgctgactccgacggctcctcttcctctacagcaagctcaccgtggacaagagca |
| Ab10.H | acaagaccacgcctcccgtgctgactccgacggctcctcttcctctacagcaagctcaccgtggacaagagca |
| Ab11.H | acaagaccacgcctcccgtgctgactccgacggctcctcttcctctacagcaagctcaccgtggacaagagca |
| Ab11A.H | acaagaccacgcctcccgtgctgactccgacggctcctcttcctctacagcaagctcaccgtggacaagagca |
| Ab12.H | acaagaccacgcctcccgtgctgactccgacggctcctcttcctctacagcaagctcaccgtggacaagagca |
| Ab13.H | acaagaccacgcctcccgtgctgactccgacggctcctcttcctctacagcaagctcaccgtggacaagagca |
| Ab15.H | acaagaccacgcctcccgtgctgactccgacggctcctcttcctctacagcaagctcaccgtggacaagagca |
| Ab17.H | acaagaccacgcctcccgtgctgactccgacggctcctcttcctctacagcaagctcaccgtggacaagagca |

FIG. 3R
Antibody Heavy chain DNA features

| Sequence Name | Constant region |
|---|---|
| Ab13 | ggtggcagcagggaacgtcttctcatgctctcgtgatgcatgaggctctgcacaaccactacacgcagaagagcc |
| Ab15 | ggtggcagcagggaacgtcttctcatgctctccgtgatgcatgaggctctgcacaaccactacacgcagaagagcc |
| Ab17 | ggtggcagcagggaacgtcttctcatgctctccgtgatgcatgaggctctgcacaaccactacacgcagaagagcc |
| Ab1.H | ggtggcagcagggaacgtcttctcatgctctccgtgatgcatgaggctctgcacaaccactacacgcagaagagcc |
| Ab2.H | ggtggcagcagggaacgtcttctcatgctctccgtgatgcatgaggctctgcacaaccactacacgcagaagagcc |
| Ab3.H | ggtggcagcagggaacgtcttctcatgctctccgtgatgcatgaggctctgcacaaccactacacgcagaagagcc |
| Ab4.H | ggtggcagcagggaacgtcttctcatgctctccgtgatgcatgaggctctgcacaaccactacacgcagaagagcc |
| Ab6.H | ggtggcagcagggaacgtcttctcatgctctccgtgatgcatgaggctctgcacaaccactacacgcagaagagcc |
| Ab7.H | ggtggcagcagggaacgtcttctcatgctctccgtgatgcatgaggctctgcacaaccactacacgcagaagagcc |
| Ab7A.H | ggtggcagcagggaacgtcttctcatgctctccgtgatgcatgaggctctgcacaaccactacacgcagaagagcc |
| Ab10.H | ggtggcagcagggaacgtcttctcatgctctccgtgatgcatgaggctctgcacaaccactacacgcagaagagcc |
| Ab11.H | ggtggcagcagggaacgtcttctcatgctctccgtgatgcatgaggctctgcacaaccactacacgcagaagagcc |
| Ab11A.H | ggtggcagcagggaacgtcttctcatgctctccgtgatgcatgaggctctgcacaaccactacacgcagaagagcc |
| Ab12.H | ggtggcagcagggaacgtcttctcatgctctccgtgatgcatgaggctctgcacaaccactacacgcagaagagcc |
| Ab13.H | ggtggcagcagggaacgtcttctcatgctctccgtgatgcatgaggctctgcacaaccactacacgcagaagagcc |
| Ab15.H | ggtggcagcagggaacgtcttctcatgctctccgtgatgcatgaggctctgcacaaccactacacgcagaagagcc |
| Ab17.H | ggtggcagcagggaacgtcttctcatgctctccgtgatgcatgaggctctgcacaaccactacacgcagaagagcc |

FIG. 3S
Antibody Heavy chain DNA features

| Sequence Name | Constant region | |
|---|---|---|
| Ab13 | tctccctgtctccgggtaaa | (SEQ ID NO:11) |
| Ab15 | tctccctgtctccgggtaaa | (SEQ ID NO:51) |
| Ab17 | tctccctgtctccgggtaaa | (SEQ ID NO:91) |
| Ab1.H | tctccctgtctccgggtaaa | (SEQ ID NO:131) |
| Ab2.H | tctccctgtctccgggtaaa | (SEQ ID NO:171) |
| Ab3.H | tctccctgtctccgggtaaa | (SEQ ID NO:211) |
| Ab4.H | tctccctgtctccgggtaaa | (SEQ ID NO:251) |
| Ab6.H | tctccctgtctccgggtaaa | (SEQ ID NO:291) |
| Ab7.H | tctccctgtctccgggtaaa | (SEQ ID NO:331) |
| Ab7A.H | tctccctgtctccgggtaaa | (SEQ ID NO:371) |
| Ab10.H | tctccctgtctccgggtaaa | (SEQ ID NO:411) |
| Ab11.H | tctccctgtctccgggtaaa | (SEQ ID NO:451) |
| Ab11A.H | tctccctgtctccgggtaaa | (SEQ ID NO:491) |
| Ab12.H | tctccctgtctccgggtaaa | (SEQ ID NO:531) |
| Ab13.H | tctccctgtctccgggtaaa | (SEQ ID NO:571) |
| Ab15.H | tctccctgtctccgggtaaa | (SEQ ID NO:611) |
| Ab17.H | tctccctgtctccgggtaaa | (SEQ ID NO:651) |

FIG. 4A
Antibody Light chain DNA features

| Sequence Name | FR1 |
|---|---|
| Ab13 | gatattgtgatgacccagactccagcctccgtgtctgaacctgtgggaggcacagtcaccatcaagtgc |
| Ab15 | gacatcgtgatgacccagactccagcctccgtgtctgaacctgtgggaggcacagtcaccatcaagtgc |
| Ab17 | gatattgtgatgacccagactccagcctccgtgtctgaacctgtgggaggcacagtcaccatcaagtgc |
| Ab1.H | gacatccagatgacccagtctcctcctccaccctgtctgcatctgtaggagacagagtcaccatcacttgt |
| Ab2.H | gacatccagatgacccagtctcctcctccaccctgtctgcatctgtaggagacagagtcaccatcacttgt |
| Ab3.H | gacatccagatgacccagtctcctcctccaccctgtctgcatctgtaggagacagagtcaccatcacttgt |
| Ab4.H | gacatccagatgacccagtctcctcctccaccctgtctgcatctgtaggagacagagtcaccatcacttgt |
| Ab6.H | gacatccagatgacccagtctcctcctccaccctgtctgcatctgtaggagacagagtcaccatcacttgt |
| Ab7.H | gacatccagatgacccagtctcctcctccaccctgtctgcatctgtaggagacagagtcaccatcacttgt |
| Ab7A.H | gctgacatccagatgacccagtctcctcctccaccctgtctgcatctgtaggagacagagtcaccatcacttgt |
| Ab10.H | gacatccagatgacccagtctcctcctccaccctgtctgcatctgtaggagacagagtcaccatcacttgt |
| Ab11.H | gacatccagatgacccagtctcctcctccaccctgtctgcatctgtaggagacagagtcaccatcacttgt |
| Ab11A.H | gacatccagatgacccagtctcctcctccaccctgtctgcatctgtaggagacagagtcaccatcacttgt |
| Ab12.H | gacatccagatgacccagtctcctcctccaccctgtctgcatctgtaggagacagagtcaccatcacttgt |
| Ab13.H | gacatccagatgacccagtctcctcctccaccctgtctgcatctgtaggagacagagtcaccatcacttgt |
| Ab15.H | gacatccagatgacccagtctcctcctccaccctgtctgcatctgtaggagacagagtcaccatcacttgt |
| Ab17.H | gacatccagatgacccagtctcctcctccaccctgtctgcatctgtaggagacagagtcaccatcacttgt |

FIG. 4B
Antibody Light chain DNA features

| Sequence Name | CDR1 | FR2 |
|---|---|---|
| Ab13 | caggccagtcagagccattagtagcgacttagcc | tggtatcagcagaaaccagggcagcctcccaagctcctgatct |
| Ab15 | caggccagtgagacattgaaagcgatttagcc | tggtatcagcagaaaccagggcagcctcccaagctcctgatct |
| Ab17 | caggccagtcagagccattagtagcgacttagcc | tggtatcagcagaaaccagggcagcctcccaagctcctgatct |
| Ab1.H | caggccagtcagagcattagtagttacttagcc | tggtatcagcagaaaccaggaaaagcccctaagctcctgatct |
| Ab2.H | caggccagtcagagcattagtaactacttagcc | tggtatcagcagaaaccaggaaaagcccctaagctcctgatct |
| Ab3.H | caggccagtgaggatattagtagtaacttagcc | tggtatcagcagaaaccaggaaaagcccctaagctcctgatct |
| Ab4.H | agagccagtcagagccattagtgtctacctcgcc | tggtatcagcagaaaccaggaaaagcccctaagctcctgatct |
| Ab6.H | caggccactcagagcattggtaataacttagcc | tggtatcagcagaaaccaggaaaagcccctaagctcctgatct |
| Ab7.H | caggccagtcagagcattagtgtgattacttatcc | tggtatcagcagaaaccaggaaaagcccctaagctcctgatct |
| Ab7A.H | caggccagtcagagcattagtgattacttatcc | tggtatcagcagaaaccaggaaaagcccctaagctcctgatct |
| Ab10.H | caggccagtgagaacatttacaggtctttagcc | tggtatcagcagaaaccaggaaaagcccctaagctcctgatct |
| Ab11.H | caggccagtcagagcattgatagtagcttggcc | tggtatcagcagaaaccaggaaaagcccctaagctcctgatct |
| Ab11A.H | caggccagtcagagcattggtagtagcttggcc | tggtatcagcagaaaccaggaaaagcccctaagctcctgatct |
| Ab12.H | caggccagtcagagcattggtagtagcttagcc | tggtatcagcagaaaccaggaaaagcccctaagctcctgatct |
| Ab13.H | caggccagtcagagccattagtagcgacttagcc | tggtatcagcagaaaccaggaaaagcccctaagctcctgatct |
| Ab15.H | caggccagtgaggacattgaaagcgatttagcc | tggtatcagcagaaaccaggaaaagcccctaagctcctgatct |
| Ab17.H | caggccagtcagaccattagtagcgacttagcc | tggtatcagcagaaaccaggaaaagcccctaagctcctgatct |

FIG. 4C
Antibody Light chain DNA features

| Sequence Name | FR2 | CDR2 | FR3 |
|---|---|---|---|
| Ab13 | at | gctgcatccaagctgacatct | ggggtctcatcgcgcttcaaaggcgtggaactggaacacagttcactctca |
| Ab15 | at | ggtgcatcctctgaagtct | ggggtctcatcaagttcagaggcagtggatctgggacagagtacactctca |
| Ab17 | at | gctgcatccaaactgacatct | ggggtctcatcgcgcttcaaaggcgtggaactggaacacagttcactctca |
| Ab1.H | at | tctgcatccactctggcatct | ggagtcccatcaagttcagcggcagtggatctggaacagaattcactctca |
| Ab2.H | at | tctgcatccactctggcatct | ggagtcccatcaagttcagcggcagtggatctggaacagaattcactctca |
| Ab3.H | at | tctgcatccactctggcatct | ggagtcccatcaagttcagcggcagtggatctggaacagaattcactctca |
| Ab4.H | at | caggcatccaaactggcctct | ggagtcccatcaagttcagcggcagtggatctggaacagaattactctca |
| Ab6.H | at | agggcatctctggcatct | ggagtcccatcaagttcagcggcagtggatctggaacagaattcactctca |
| Ab7.H | at | agggcatccactctggcatct | ggagtcccatcaagttcagcggcagtggatctggaacagaattcactctca |
| Ab7A.H | at | agggcatccactctggcatct | ggagtcccatcaagttcagcggcagtggatctggaacagaattcactctca |
| Ab10.H | at | tctgcatccactctggcatct | ggagtcccatcaagttcagcggcagtggatctggaacagaattcactctca |
| Ab11.H | at | tctgcatccactctggcatct | ggagtcccatcaagttcagcggcagtggatctggaacagaattcactctca |
| Ab11A.H | at | tctgcatccactctggcatct | ggagtcccatcaagttcagcggcagtggatctggaacagaattcactctca |
| Ab12.H | at | gctgcatccactctggcatct | ggagtcccatcaagttcagcggcagtggatctggaacagaattcactctca |
| Ab13.H | at | gctgcatccaagctgacatct | ggagtcccatcaagttcagcggcagtggatctggaacagaattcactctca |
| Ab15.H | at | ggtgcatcctctgaagtct | ggagtcccatcaagttcagcggcagtggatctggaacagaatacactctca |
| Ab17.H | at | gctgcatccaaactgacatct | ggagtcccatcaagttcagcggcagtggatctggaacagaattcactctca |

FIG. 4D
Antibody Light chain DNA features

| Sequence Name | FR3 | CDR3 |
|---|---|---|
| Ab13 | ccatcagcgacctggagtgtgccgatgctgccacttactactgt | caaacatattatgatattattgatgatggtt |
| Ab15 | ccatcagcgacctggagtgtgccgatgctgccacttactactgt | caaacctattatgatatggctgatgatggtt |
| Ab17 | ccatcagcgacctggagtgtgccgatgctgccacttactactgt | caaacctattatgatattagtgatgatggtt |
| Ab1.H | ccatcagcagcctgcagcctgatgattttgcaacttactactgt | caaagctatgatggtagtggtagtagtagtt |
| Ab2.H | ccatcagcagcctgcagcctgatgattttgcaacttactactgt | caaagctatgatgagggtagtggtagtagtt |
| Ab3.H | ccatcagcagcctgcagcctgatgattttgcaacttactactgt | caaagctatgatggtagtagtagtagtagtt |
| Ab4.H | ccatcagcagcctgcagcctgatgattttgcaacttactactgt | caaagctatgatggtagtagtagtagtagtt |
| Ab6.H | ccatcagcagcctgcagcctgatgattttgcaacttactactgt | caaagctatgatggtagtagtagtagtagtt |
| Ab7.H | ccatcagcagcctgcagcctgatgattttgcaacttactactgt | caaagctattactagtagtagtagtattactt |
| Ab7A.H | ccatcagcagcctgcagcctgatgattttgcaacttactactgt | caaagctattactagtagtagtagtattactt |
| Ab10.H | ccatcagcagcctgcagcctgatgattttgcaacttactactgt | caaagctatgatggtagtagtagtagtagtt |
| Ab11.H | ccatcagcagcctgcagcctgatgattttgcaacttactactgt | caaagctatgatgatggtagtagtagttact |
| Ab11A.H | ccatcagcagcctgcagcctgatgattttgcaacttactactgt | caaagctatgaaggtagtagtagtagttact |
| Ab12.H | ccatcagcagcctgcagcctgatgattttgcaacttactactgt | caaagctatgatggtagtagtagtagtagtt |
| Ab13.H | ccatcagcagcctgcagcctgatgattttgcaacttactactgt | caaacatactatgatatcattgatgatggtg |
| Ab15.H | ccatcagcagcctgcagcctgatgattttgcaacttactactgt | caaacctattatgatatggctgatgatggtg |
| Ab17.H | ccatcagcagcctgcagcctgatgattttgcaacttactactgt | caaacctattatgatattagtgatgatggtg |

FIG. 4E
Antibody Light chain DNA features

| Sequence Name | CDR3 | FR4 | Constant region |
|---|---|---|---|
| Ab13 | gtact | ttcggcggagggaccgaggtggtcaaacgt | acggtagcggcccatctgtcttcatcttcc |
| Ab15 | gtagt | ttcggcggagggaccgaggtggtcaaacgt | acggtagcggcccatctgtcttcatcttcc |
| Ab17 | gtact | ttcggcggagggaccgaggtggtcaaacgt | acggtagcggcccatctgtcttcatcttcc |
| Ab1.H | atggtgttggt | ttcggcggaggaaccaaggtggaaatcaaacgt | acggtggctgcaccatctgtcttcatcttcc |
| Ab2.H | atggtgttggt | ttcggcggaggaaccaaggtggaaatcaaacgt | acggtggctgcaccatctgtcttcatcttcc |
| Ab3.H | atggtattggt | ttcggcggaggaaccaaggtggaaatcaaacgt | acggtggctgcaccatctgtcttcatcttcc |
| Ab4.H | atggtgttggt | ttcggcggaggaaccaaggtggaaatcaaacgt | acggtggctgcaccatctgtcttcatcttcc |
| Ab6.H | atcataatgct | ttcggcggaggaaccaaggtggaaatcaaacgt | acggtagcggcccatctgtcttcatcttcc |
| Ab7.H | atcgtaatgct | ttcggcggaggaaccaaggtggaaatcaaacgt | acggtagcggcccatctgtcttcatcttcc |
| Ab7A.H | atcgtaatgct | ttcggcggaggaaccaaggtggaaatcaaacgt | acggtagcggcccatctgtcttcatcttcc |
| Ab10.H | atggtgttggt | ttcggcggaggaaccaaggtggaaatcaaacgt | acggtggctgcaccatctgtcttcatcttcc |
| Ab11.H | atggtattggt | ttcggcggaggaaccaaggtggaaatcaaacgt | acggtggctgcaccatctgtcttcatcttcc |
| Ab11A.H | atggtattggt | ttcggcggaggaaccaaggtggaaatcaaacgt | acggtggctgcaccatctgtcttcatcttcc |
| Ab12.H | atggtgttggt | ttcggcggaggaaccaaggtggaaatcaaacgt | acggtggctgcaccatctgtcttcatcttcc |
| Ab13.H | ctagt | ttcggcggaggaaccaaggtggaaatcaaacgt | acggtagcggcccatctgtcttcatcttcc |
| Ab15.H | ctagt | ttcggcggaggaaccaaggtggaaatcaaacgt | acggtagcggcccatctgtcttcatcttcc |
| Ab17.H | ctact | ttcggcggaggaaccaaggtggaaatcaaacgt | acggtagcggcccatctgtcttcatcttcc |

FIG. 4F
Antibody Light chain DNA features

| Sequence Name | Constant region |
|---|---|
| Ab13 | cgccatctgatgagcagttgaaatctgaactgcctctgttgtgctgctgaataacttctatcccagagagg |
| Ab15 | cgccatctgatgagcagttgaaatctgaactgcctctgttgtgctgctgaataacttctatcccagagagg |
| Ab17 | cgccatctgatgagcagttgaaatctgaactgcctctgttgtgctgctgaataacttctatcccagagagg |
| Ab1.H | cgccatctgatgagcagttgaaatctgaactgcctctgttgtgctgctgaataacttctatcccagagagg |
| Ab2.H | cgccatctgatgagcagttgaaatctgaactgcctctgttgtgctgctgaataacttctatcccagagagg |
| Ab3.H | cgccatctgatgagcagttgaaatctgaactgcctctgttgtgctgctgaataacttctatcccagagagg |
| Ab4.H | cgccatctgatgagcagttgaaatctgaactgcctctgttgtgctgctgaataacttctatcccagagagg |
| Ab6.H | cgccatctgatgagcagttgaaatctgaactgcctctgttgtgctgctgaataacttctatcccagagagg |
| Ab7.H | cgccatctgatgagcagttgaaatctgaactgcctctgttgtgctgctgaataacttctatcccagagagg |
| Ab7A.H | cgccatctgatgagcagttgaaatctgaactgcctctgttgtgctgctgaataacttctatcccagagagg |
| Ab10.H | cgccatctgatgagcagttgaaatctgaactgcctctgttgtgctgctgaataacttctatcccagagagg |
| Ab11.H | cgccatctgatgagcagttgaaatctgaactgcctctgttgtgctgctgaataacttctatcccagagagg |
| Ab11A.H | cgccatctgatgagcagttgaaatctgaactgcctctgttgtgctgctgaataacttctatcccagagagg |
| Ab12.H | cgccatctgatgagcagttgaaatctgaactgcctctgttgtgctgctgaataacttctatcccagagagg |
| Ab13.H | cgccatctgatgagcagttgaaatctgaactgcctctgttgtgctgctgaataacttctatcccagagagg |
| Ab15.H | cgccatctgatgagcagttgaaatctgaactgcctctgttgtgctgctgaataacttctatcccagagagg |
| Ab17.H | cgccatctgatgagcagttgaaatctgaactgcctctgttgtgctgctgaataacttctatcccagagagg |

FIG. 4G
Antibody Light chain DNA features

| Sequence Name | Constant region |
|---|---|
| Ab13 | ccaaagtacagtggaaggtggataacgcccctccaatcgggtaactcccaggagagtgtcacagagcaggacagca |
| Ab15 | ccaaagtacagtggaaggtggataacgcccctccaatcgggtaactcccaggagagtgtcacagagcaggacagca |
| Ab17 | ccaaagtacagtggaaggtggataacgcccctccaatcgggtaactcccaggagagtgtcacagagcaggacagca |
| Ab1.H | ccaaagtacagtggaaggtggataacgcccctccaatcgggtaactcccaggagagtgtcacagagcaggacagca |
| Ab2.H | ccaaagtacagtggaaggtggataacgcccctccaatcgggtaactcccaggagagtgtcacagagcaggacagca |
| Ab3.H | ccaaagtacagtggaaggtggataacgcccctccaatcgggtaactcccaggagagtgtcacagagcaggacagca |
| Ab4.H | ccaaagtacagtggaaggtggataacgcccctccaatcgggtaactcccaggagagtgtcacagagcaggacagca |
| Ab6.H | ccaaagtacagtggaaggtggataacgcccctccaatcgggtaactcccaggagagtgtcacagagcaggacagca |
| Ab7.H | ccaaagtacagtggaaggtggataacgcccctccaatcgggtaactcccaggagagtgtcacagagcaggacagca |
| Ab7A.H | ccaaagtacagtggaaggtggataacgcccctccaatcgggtaactcccaggagagtgtcacagagcaggacagca |
| Ab10.H | ccaaagtacagtggaaggtggataacgcccctccaatcgggtaactcccaggagagtgtcacagagcaggacagca |
| Ab11.H | ccaaagtacagtggaaggtggataacgcccctccaatcgggtaactcccaggagagtgtcacagagcaggacagca |
| Ab11A.H | ccaaagtacagtggaaggtggataacgcccctccaatcgggtaactcccaggagagtgtcacagagcaggacagca |
| Ab12.H | ccaaagtacagtggaaggtggataacgcccctccaatcgggtaactcccaggagagtgtcacagagcaggacagca |
| Ab13.H | ccaaagtacagtggaaggtggataacgcccctccaatcgggtaactcccaggagagtgtcacagagcaggacagca |
| Ab15.H | ccaaagtacagtggaaggtggataacgcccctccaatcgggtaactcccaggagagtgtcacagagcaggacagca |
| Ab17.H | ccaaagtacagtggaaggtggataacgcccctccaatcgggtaactcccaggagagtgtcacagagcaggacagca |

FIG. 4H
Antibody Light chain DNA features

| Sequence Name | Constant region |
|---|---|
| Ab13 | aggacagcacctacagcctcagcagcacccctgagcagcctgagcaaagcagactacgagaaacacaaagtctacgcct |
| Ab15 | aggacagcacctacagcctcagcagcacccctgagcagcctgagcaaagcagactacgagaaacacaaagtctacgcct |
| Ab17 | aggacagcacctacagcctcagcagcacccctgagcagcctgagcaaagcagactacgagaaacacaaagtctacgcct |
| Ab1.H | aggacagcacctacagcctcagcagcacccctgagcagcctgagcaaagcagactacgagaaacacaaagtctacgcct |
| Ab2.H | aggacagcacctacagcctcagcagcacccctgagcagcctgagcaaagcagactacgagaaacacaaagtctacgcct |
| Ab3.H | aggacagcacctacagcctcagcagcacccctgagcagcctgagcaaagcagactacgagaaacacaaagtctacgcct |
| Ab4.H | aggacagcacctacagcctcagcagcacccctgagcagcctgagcaaagcagactacgagaaacacaaagtctacgcct |
| Ab6.H | aggacagcacctacagcctcagcagcacccctgagcagcctgagcaaagcagactacgagaaacacaaagtctacgcct |
| Ab7.H | aggacagcacctacagcctcagcagcacccctgagcagcctgagcaaagcagactacgagaaacacaaagtctacgcct |
| Ab7A.H | aggacagcacctacagcctcagcagcacccctgagcagcctgagcaaagcagactacgagaaacacaaagtctacgcct |
| Ab10.H | aggacagcacctacagcctcagcagcacccctgagcagcctgagcaaagcagactacgagaaacacaaagtctacgcct |
| Ab11.H | aggacagcacctacagcctcagcagcacccctgagcagcctgagcaaagcagactacgagaaacacaaagtctacgcct |
| Ab11A.H | aggacagcacctacagcctcagcagcacccctgagcagcctgagcaaagcagactacgagaaacacaaagtctacgcct |
| Ab12.H | aggacagcacctacagcctcagcagcacccctgagcagcctgagcaaagcagactacgagaaacacaaagtctacgcct |
| Ab13.H | aggacagcacctacagcctcagcagcacccctgagcagcctgagcaaagcagactacgagaaacacaaagtctacgcct |
| Ab15.H | aggacagcacctacagcctcagcagcacccctgagcagcctgagcaaagcagactacgagaaacacaaagtctacgcct |
| Ab17.H | aggacagcacctacagcctcagcagcacccctgagcagcctgagcaaagcagactacgagaaacacaaagtctacgcct |

FIG. 4I
Antibody Light chain DNA features

| Sequence Name | Constant region | |
|---|---|---|
| Ab13 | gcgaagtcacccatcagggcctgagctcgcccgtcacaaagagcttcaacagggagagtgt | (SEQ ID NO:31) |
| Ab15 | gcgaagtcacccatcagggcctgagctcgcccgtcacaaagagcttcaacagggagagtgt | (SEQ ID NO:71) |
| Ab17 | gcgaagtcacccatcagggcctgagctcgcccgtcacaaagagcttcaacagggagagtgt | (SEQ ID NO:111) |
| Ab1.H | gcgaagtcacccatcagggcctgagctcgcccgtcacaaagagcttcaacagggagagtgt | (SEQ ID NO:151) |
| Ab2.H | gcgaagtcacccatcagggcctgagctcgcccgtcacaaagagcttcaacagggagagtgt | (SEQ ID NO:191) |
| Ab3.H | gcgaagtcacccatcagggcctgagctcgcccgtcacaaagagcttcaacagggagagtgt | (SEQ ID NO:231) |
| Ab4.H | gcgaagtcacccatcagggcctgagctcgcccgtcacaaagagcttcaacagggagagtgt | (SEQ ID NO:271) |
| Ab6.H | gcgaagtcacccatcagggcctgagctcgcccgtcacaaagagcttcaacagggagagtgt | (SEQ ID NO:311) |
| Ab7.H | gcgaagtcacccatcagggcctgagctcgcccgtcacaaagagcttcaacagggagagtgt | (SEQ ID NO:351) |
| Ab7A.H | gcgaagtcacccatcagggcctgagctcgcccgtcacaaagagcttcaacagggagagtgt | (SEQ ID NO:391) |
| Ab10.H | gcgaagtcacccatcagggcctgagctcgcccgtcacaaagagcttcaacagggagagtgt | (SEQ ID NO:431) |
| Ab11.H | gcgaagtcacccatcagggcctgagctcgcccgtcacaaagagcttcaacagggagagtgt | (SEQ ID NO:471) |
| Ab11A.H | gcgaagtcacccatcagggcctgagctcgcccgtcacaaagagcttcaacagggagagtgt | (SEQ ID NO:511) |
| Ab12.H | gcgaagtcacccatcagggcctgagctcgcccgtcacaaagagcttcaacagggagagtgt | (SEQ ID NO:551) |
| Ab13.H | gcgaagtcacccatcagggcctgagctcgcccgtcacaaagagcttcaacagggagagtgt | (SEQ ID NO:591) |
| Ab15.H | gcgaagtcacccatcagggcctgagctcgcccgtcacaaagagcttcaacagggagagtgt | (SEQ ID NO:631) |
| Ab17.H | gcgaagtcacccatcagggcctgagctcgcccgtcacaaagagcttcaacagggagagtgt | (SEQ ID NO:671) |

FIG. 5A
Antibody Heavy chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab13 | 1-113 | 2 | 30-35 | 4 | 50-66 | 6 | 98-102 | 8 |
| Ab15 | 1-114 | 42 | 31-36 | 44 | 51-67 | 46 | 99-103 | 48 |
| Ab17 | 1-114 | 82 | 31-36 | 84 | 51-67 | 86 | 99-103 | 88 |
| Ab1.H | 1-113 | 122 | 31-35 | 124 | 50-65 | 126 | 98-102 | 128 |
| Ab2.H | 1-113 | 162 | 31-35 | 164 | 50-65 | 166 | 98-102 | 168 |
| Ab3.H | 1-113 | 202 | 31-35 | 204 | 50-65 | 206 | 98-102 | 208 |
| Ab4.H | 1-113 | 242 | 31-35 | 244 | 50-65 | 246 | 98-102 | 248 |
| Ab6.H | 1-124 | 282 | 31-35 | 284 | 50-65 | 286 | 98-113 | 288 |
| Ab7.H | 1-124 | 322 | 31-35 | 324 | 50-65 | 326 | 98-113 | 328 |
| Ab7A.H | 1-124 | 362 | 31-35 | 364 | 50-65 | 366 | 98-113 | 368 |
| Ab10.H | 1-113 | 402 | 31-35 | 404 | 50-65 | 406 | 98-102 | 408 |
| Ab11.H | 1-113 | 442 | 31-35 | 444 | 50-65 | 446 | 98-102 | 448 |
| Ab11A.H | 1-113 | 482 | 31-35 | 484 | 50-65 | 486 | 98-102 | 488 |
| Ab12.H | 1-113 | 522 | 31-35 | 524 | 50-65 | 526 | 98-102 | 528 |
| Ab13.H | 1-115 | 562 | 31-36 | 564 | 51-67 | 566 | 100-104 | 568 |
| Ab15.H | 1-115 | 602 | 31-36 | 604 | 51-67 | 606 | 100-104 | 608 |
| Ab17.H | 1-115 | 642 | 31-36 | 644 | 51-67 | 646 | 100-104 | 648 |

FIG. 5B
Antibody Heavy chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-110 | 682 | 30-34 | 684 | 49-64 | 686 | 95-99 | 688 |
| Ab2 | 1-110 | 722 | 30-34 | 724 | 49-64 | 726 | 95-99 | 728 |
| Ab3 | 1-111 | 762 | 30-34 | 764 | 49-64 | 766 | 96-100 | 768 |
| Ab4 | 1-110 | 802 | 30-34 | 804 | 49-64 | 806 | 95-99 | 808 |
| Ab5 | 1-121 | 842 | 30-34 | 844 | 49-64 | 846 | 95-110 | 848 |
| Ab6 | 1-121 | 882 | 30-34 | 884 | 49-64 | 886 | 95-110 | 888 |
| Ab7 | 1-121 | 922 | 30-34 | 924 | 49-64 | 926 | 95-110 | 928 |
| Ab9 | 1-121 | 962 | 30-34 | 964 | 49-64 | 966 | 95-110 | 968 |
| Ab10 | 1-110 | 1002 | 30-34 | 1004 | 49-64 | 1006 | 95-99 | 1008 |
| Ab11 | 1-110 | 1042 | 30-34 | 1044 | 49-64 | 1046 | 95-99 | 1048 |
| Ab12 | 1-110 | 1082 | 30-34 | 1084 | 49-64 | 1086 | 95-99 | 1088 |

FIG. 6B
Antibody Heavy chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-29 | 683 | 35-48 | 685 | 65-94 | 687 | 100-110 | 689 | 111-440 | 690 |
| Ab2 | 1-29 | 723 | 35-48 | 725 | 65-94 | 727 | 100-110 | 729 | 111-440 | 730 |
| Ab3 | 1-29 | 763 | 35-48 | 765 | 65-95 | 767 | 101-111 | 769 | 112-441 | 770 |
| Ab4 | 1-29 | 803 | 35-48 | 805 | 65-94 | 807 | 100-110 | 809 | 111-440 | 810 |
| Ab5 | 1-29 | 843 | 35-48 | 845 | 65-94 | 847 | 111-121 | 849 | 122-451 | 850 |
| Ab6 | 1-29 | 883 | 35-48 | 885 | 65-94 | 887 | 111-121 | 889 | 122-451 | 890 |
| Ab7 | 1-29 | 923 | 35-48 | 925 | 65-94 | 927 | 111-121 | 929 | 122-451 | 930 |
| Ab9 | 1-29 | 963 | 35-48 | 965 | 65-94 | 967 | 111-121 | 969 | 122-451 | 970 |
| Ab10 | 1-29 | 1003 | 35-48 | 1005 | 65-94 | 1007 | 100-110 | 1009 | 111-440 | 1010 |
| Ab11 | 1-29 | 1043 | 35-48 | 1045 | 65-94 | 1047 | 100-110 | 1049 | 111-440 | 1050 |
| Ab12 | 1-29 | 1083 | 35-48 | 1085 | 65-94 | 1087 | 100-110 | 1089 | 111-440 | 1090 |

FIG. 6A
Antibody Heavy chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab13 | 1-29 | 3 | 36-49 | 5 | 67-97 | 7 | 103-113 | 9 | 114-443 | 10 |
| Ab15 | 1-30 | 43 | 37-50 | 45 | 68-98 | 47 | 104-114 | 49 | 115-444 | 50 |
| Ab17 | 1-30 | 83 | 37-50 | 85 | 68-98 | 87 | 104-114 | 89 | 115-444 | 90 |
| Ab1.H | 1-30 | 123 | 36-49 | 125 | 66-97 | 127 | 103-113 | 129 | 114-443 | 130 |
| Ab2.H | 1-30 | 163 | 36-49 | 165 | 66-97 | 167 | 103-113 | 169 | 114-443 | 170 |
| Ab3.H | 1-30 | 203 | 36-49 | 205 | 66-97 | 207 | 103-113 | 209 | 114-443 | 210 |
| Ab4.H | 1-30 | 243 | 36-49 | 245 | 66-97 | 247 | 103-113 | 249 | 114-443 | 250 |
| Ab6.H | 1-30 | 283 | 36-49 | 285 | 66-97 | 287 | 114-124 | 289 | 125-454 | 290 |
| Ab7.H | 1-30 | 323 | 36-49 | 325 | 66-97 | 327 | 114-124 | 329 | 125-454 | 330 |
| Ab7A.H | 1-30 | 363 | 36-49 | 365 | 66-97 | 367 | 114-124 | 369 | 125-454 | 370 |
| Ab10.H | 1-30 | 403 | 36-49 | 405 | 66-97 | 407 | 103-113 | 409 | 114-443 | 410 |
| Ab11.H | 1-30 | 443 | 36-49 | 445 | 66-97 | 447 | 103-113 | 449 | 114-443 | 450 |
| Ab11A.H | 1-30 | 483 | 36-49 | 485 | 66-97 | 487 | 103-113 | 489 | 114-443 | 490 |
| Ab12.H | 1-30 | 523 | 36-49 | 525 | 66-97 | 527 | 103-113 | 529 | 114-443 | 530 |
| Ab13.H | 1-30 | 563 | 37-50 | 565 | 68-99 | 567 | 105-115 | 569 | 116-445 | 570 |
| Ab15.H | 1-30 | 603 | 37-50 | 605 | 68-99 | 607 | 105-115 | 609 | 116-445 | 610 |
| Ab17.H | 1-30 | 643 | 37-50 | 645 | 68-99 | 647 | 105-115 | 649 | 116-445 | 650 |

FIG. 7A
Antibody Light chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab13 | 1-111 | 22 | 24-34 | 24 | 50-56 | 26 | 89-100 | 28 |
| Ab15 | 1-111 | 62 | 24-34 | 64 | 50-56 | 66 | 89-100 | 68 |
| Ab17 | 1-111 | 102 | 24-34 | 104 | 50-56 | 106 | 89-100 | 108 |
| Ab1.H | 1-113 | 142 | 24-34 | 144 | 50-56 | 146 | 89-102 | 148 |
| Ab2.H | 1-113 | 182 | 24-34 | 184 | 50-56 | 186 | 89-102 | 188 |
| Ab3.H | 1-113 | 222 | 24-34 | 224 | 50-56 | 226 | 89-102 | 228 |
| Ab4.H | 1-113 | 262 | 24-34 | 264 | 50-56 | 266 | 89-102 | 268 |
| Ab6.H | 1-113 | 302 | 24-34 | 304 | 50-56 | 306 | 89-102 | 308 |
| Ab7.H | 1-113 | 342 | 24-34 | 344 | 50-56 | 346 | 89-102 | 348 |
| Ab7A.H | 1-114 | 382 | 25-35 | 384 | 51-57 | 386 | 90-103 | 388 |
| Ab10.H | 1-113 | 422 | 24-34 | 424 | 50-56 | 426 | 89-102 | 428 |
| Ab11.H | 1-113 | 462 | 24-34 | 464 | 50-56 | 466 | 89-102 | 468 |
| Ab11A.H | 1-113 | 502 | 24-34 | 504 | 50-56 | 506 | 89-102 | 508 |
| Ab12.H | 1-113 | 542 | 24-34 | 544 | 50-56 | 546 | 89-102 | 548 |
| Ab13.H | 1-111 | 582 | 24-34 | 584 | 50-56 | 586 | 89-100 | 588 |
| Ab15.H | 1-111 | 622 | 24-34 | 624 | 50-56 | 626 | 89-100 | 628 |
| Ab17.H | 1-111 | 662 | 24-34 | 664 | 50-56 | 666 | 89-100 | 668 |

FIG. 7B
Antibody Light chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1  | 1-113 | 702  | 24-34 | 704  | 50-56 | 706  | 89-102 | 708  |
| Ab2  | 1-113 | 742  | 24-34 | 744  | 50-56 | 746  | 89-102 | 748  |
| Ab3  | 1-113 | 782  | 24-34 | 784  | 50-56 | 786  | 89-102 | 788  |
| Ab4  | 1-113 | 822  | 24-34 | 824  | 50-56 | 826  | 89-102 | 828  |
| Ab5  | 1-114 | 862  | 25-35 | 864  | 51-57 | 866  | 90-103 | 868  |
| Ab6  | 1-114 | 902  | 25-35 | 904  | 51-57 | 906  | 90-103 | 908  |
| Ab7  | 1-114 | 942  | 25-35 | 944  | 51-57 | 946  | 90-103 | 948  |
| Ab9  | 1-114 | 982  | 25-35 | 984  | 51-57 | 986  | 90-103 | 988  |
| Ab10 | 1-113 | 1022 | 24-34 | 1024 | 50-56 | 1026 | 89-102 | 1028 |
| Ab11 | 1-113 | 1062 | 24-34 | 1064 | 50-56 | 1066 | 89-102 | 1068 |
| Ab12 | 1-113 | 1102 | 24-34 | 1104 | 50-56 | 1106 | 89-102 | 1108 |

FIG. 8B
Antibody Light chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1  | 1-23 | 703  | 35-49 | 705  | 57-88 | 707  | 103-113 | 709  | 114-219 | 710  |
| Ab2  | 1-23 | 743  | 35-49 | 745  | 57-88 | 747  | 103-113 | 749  | 114-219 | 750  |
| Ab3  | 1-23 | 783  | 35-49 | 785  | 57-88 | 787  | 103-113 | 789  | 114-219 | 790  |
| Ab4  | 1-23 | 823  | 35-49 | 825  | 57-88 | 827  | 103-113 | 829  | 114-219 | 830  |
| Ab5  | 1-24 | 863  | 36-50 | 865  | 58-89 | 867  | 104-114 | 869  | 115-220 | 870  |
| Ab6  | 1-24 | 903  | 36-50 | 905  | 58-89 | 907  | 104-114 | 909  | 115-220 | 910  |
| Ab7  | 1-24 | 943  | 36-50 | 945  | 58-89 | 947  | 104-114 | 949  | 115-220 | 950  |
| Ab9  | 1-24 | 983  | 36-50 | 985  | 58-89 | 987  | 104-114 | 989  | 115-220 | 990  |
| Ab10 | 1-23 | 1023 | 35-49 | 1025 | 57-88 | 1027 | 103-113 | 1029 | 114-219 | 1030 |
| Ab11 | 1-23 | 1063 | 35-49 | 1065 | 57-88 | 1067 | 103-113 | 1069 | 114-219 | 1070 |
| Ab12 | 1-23 | 1103 | 35-49 | 1105 | 57-88 | 1107 | 103-113 | 1109 | 114-219 | 1110 |

FIG. 8A
Antibody Light chain Protein features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab13 | 1-23 | 23 | 35-49 | 25 | 57-88 | 27 | 101-111 | 29 | 112-217 | 30 |
| Ab15 | 1-23 | 63 | 35-49 | 65 | 57-88 | 67 | 101-111 | 69 | 112-217 | 70 |
| Ab17 | 1-23 | 103 | 35-49 | 105 | 57-88 | 107 | 101-111 | 109 | 112-217 | 110 |
| Ab1.H | 1-23 | 143 | 35-49 | 145 | 57-88 | 147 | 103-113 | 149 | 114-219 | 150 |
| Ab2.H | 1-23 | 183 | 35-49 | 185 | 57-88 | 187 | 103-113 | 189 | 114-219 | 190 |
| Ab3.H | 1-23 | 223 | 35-49 | 225 | 57-88 | 227 | 103-113 | 229 | 114-219 | 230 |
| Ab4.H | 1-23 | 263 | 35-49 | 265 | 57-88 | 267 | 103-113 | 269 | 114-219 | 270 |
| Ab6.H | 1-23 | 303 | 35-49 | 305 | 57-88 | 307 | 103-113 | 309 | 114-219 | 310 |
| Ab7.H | 1-23 | 343 | 35-49 | 345 | 57-88 | 347 | 103-113 | 349 | 114-219 | 350 |
| Ab7A.H | 1-24 | 383 | 36-50 | 385 | 58-89 | 387 | 104-114 | 389 | 115-220 | 390 |
| Ab10.H | 1-23 | 423 | 35-49 | 425 | 57-88 | 427 | 103-113 | 429 | 114-219 | 430 |
| Ab11.H | 1-23 | 463 | 35-49 | 465 | 57-88 | 467 | 103-113 | 469 | 114-219 | 470 |
| Ab11A.H | 1-23 | 503 | 35-49 | 505 | 57-88 | 507 | 103-113 | 509 | 114-219 | 510 |
| Ab12.H | 1-23 | 543 | 35-49 | 545 | 57-88 | 547 | 103-113 | 549 | 114-219 | 550 |
| Ab13.H | 1-23 | 583 | 35-49 | 585 | 57-88 | 587 | 101-111 | 589 | 112-217 | 590 |
| Ab15.H | 1-23 | 623 | 35-49 | 625 | 57-88 | 627 | 101-111 | 629 | 112-217 | 630 |
| Ab17.H | 1-23 | 663 | 35-49 | 665 | 57-88 | 667 | 101-111 | 669 | 112-217 | 670 |

FIG. 9A
Antibody Heavy chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab13 | 1-339 | 12 | 88-105 | 14 | 148-198 | 16 | 292-306 | 18 |
| Ab15 | 1-342 | 52 | 91-108 | 54 | 151-201 | 56 | 295-309 | 58 |
| Ab17 | 1-342 | 92 | 91-108 | 94 | 151-201 | 96 | 295-309 | 98 |
| Ab1.H | 1-339 | 132 | 91-105 | 134 | 148-195 | 136 | 292-306 | 138 |
| Ab2.H | 1-339 | 172 | 91-105 | 174 | 148-195 | 176 | 292-306 | 178 |
| Ab3.H | 1-339 | 212 | 91-105 | 214 | 148-195 | 216 | 292-306 | 218 |
| Ab4.H | 1-339 | 252 | 91-105 | 254 | 148-195 | 256 | 292-306 | 258 |
| Ab6.H | 1-372 | 292 | 91-105 | 294 | 148-195 | 296 | 292-339 | 298 |
| Ab7.H | 1-372 | 332 | 91-105 | 334 | 148-195 | 336 | 292-339 | 338 |
| Ab7A.H | 1-372 | 372 | 91-105 | 374 | 148-195 | 376 | 292-339 | 378 |
| Ab10.H | 1-339 | 412 | 91-105 | 414 | 148-195 | 416 | 292-306 | 418 |
| Ab11.H | 1-339 | 452 | 91-105 | 454 | 148-195 | 456 | 292-306 | 458 |
| Ab11A.H | 1-339 | 492 | 91-105 | 494 | 148-195 | 496 | 292-306 | 498 |
| Ab12.H | 1-339 | 532 | 91-105 | 534 | 148-195 | 536 | 292-306 | 538 |
| Ab13.H | 1-345 | 572 | 91-108 | 574 | 151-201 | 576 | 298-312 | 578 |
| Ab15.H | 1-345 | 612 | 91-108 | 614 | 151-201 | 616 | 298-312 | 618 |
| Ab17.H | 1-345 | 652 | 91-108 | 654 | 151-201 | 656 | 298-312 | 658 |

FIG. 9B
Antibody Heavy chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-330 | 692 | 88-102 | 694 | 145-192 | 696 | 283-297 | 698 |
| Ab2 | 1-330 | 732 | 88-102 | 734 | 145-192 | 736 | 283-297 | 738 |
| Ab3 | 1-333 | 772 | 88-102 | 774 | 145-192 | 776 | 286-300 | 778 |
| Ab4 | 1-330 | 812 | 88-102 | 814 | 145-192 | 816 | 283-297 | 818 |
| Ab5 | 1-363 | 852 | 88-102 | 854 | 145-192 | 856 | 283-330 | 858 |
| Ab6 | 1-363 | 892 | 88-102 | 894 | 145-192 | 896 | 283-330 | 898 |
| Ab7 | 1-363 | 932 | 88-102 | 934 | 145-192 | 936 | 283-330 | 938 |
| Ab9 | 1-363 | 972 | 88-102 | 974 | 145-192 | 976 | 283-330 | 978 |
| Ab10 | 1-330 | 1012 | 88-102 | 1014 | 145-192 | 1016 | 283-297 | 1018 |
| Ab11 | 1-330 | 1052 | 88-102 | 1054 | 145-192 | 1056 | 283-297 | 1058 |
| Ab12 | 1-330 | 1092 | 88-102 | 1094 | 145-192 | 1096 | 283-297 | 1098 |

FIG. 10B
Antibody Heavy chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-87 | 693 | 103-144 | 695 | 193-282 | 697 | 298-330 | 699 | 331-1320 | 700 |
| Ab2 | 1-87 | 733 | 103-144 | 735 | 193-282 | 737 | 298-330 | 739 | 331-1320 | 740 |
| Ab3 | 1-87 | 773 | 103-144 | 775 | 193-285 | 777 | 301-333 | 779 | 334-1323 | 780 |
| Ab4 | 1-87 | 813 | 103-144 | 815 | 193-282 | 817 | 298-330 | 819 | 331-1320 | 820 |
| Ab5 | 1-87 | 853 | 103-144 | 855 | 193-282 | 857 | 331-363 | 859 | 364-1353 | 860 |
| Ab6 | 1-87 | 893 | 103-144 | 895 | 193-282 | 897 | 331-363 | 899 | 364-1353 | 900 |
| Ab7 | 1-87 | 933 | 103-144 | 935 | 193-282 | 937 | 331-363 | 939 | 364-1353 | 940 |
| Ab9 | 1-87 | 973 | 103-144 | 975 | 193-282 | 977 | 331-363 | 979 | 364-1353 | 980 |
| Ab10 | 1-87 | 1013 | 103-144 | 1015 | 193-282 | 1017 | 298-330 | 1019 | 331-1320 | 1020 |
| Ab11 | 1-87 | 1053 | 103-144 | 1055 | 193-282 | 1057 | 298-330 | 1059 | 331-1320 | 1060 |
| Ab12 | 1-87 | 1093 | 103-144 | 1095 | 193-282 | 1097 | 298-330 | 1099 | 331-1320 | 1100 |

FIG. 10A
Antibody Heavy chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab13 | 1-87 | 13 | 106-147 | 15 | 199-291 | 17 | 307-339 | 19 | 340-1329 | 20 |
| Ab15 | 1-90 | 53 | 109-150 | 55 | 202-294 | 57 | 310-342 | 59 | 343-1332 | 60 |
| Ab17 | 1-90 | 93 | 109-150 | 95 | 202-294 | 97 | 310-342 | 99 | 343-1332 | 100 |
| Ab1.H | 1-90 | 133 | 106-147 | 135 | 196-291 | 137 | 307-339 | 139 | 340-1329 | 140 |
| Ab2.H | 1-90 | 173 | 106-147 | 175 | 196-291 | 177 | 307-339 | 179 | 340-1329 | 180 |
| Ab3.H | 1-90 | 213 | 106-147 | 215 | 196-291 | 217 | 307-339 | 219 | 340-1329 | 220 |
| Ab4.H | 1-90 | 253 | 106-147 | 255 | 196-291 | 257 | 307-339 | 259 | 340-1329 | 260 |
| Ab6.H | 1-90 | 293 | 106-147 | 295 | 196-291 | 297 | 340-372 | 299 | 373-1362 | 300 |
| Ab7.H | 1-90 | 333 | 106-147 | 335 | 196-291 | 337 | 340-372 | 339 | 373-1362 | 340 |
| Ab7A.H | 1-90 | 373 | 106-147 | 375 | 196-291 | 377 | 340-372 | 379 | 373-1362 | 380 |
| Ab10.H | 1-90 | 413 | 106-147 | 415 | 196-291 | 417 | 307-339 | 419 | 340-1329 | 420 |
| Ab11.H | 1-90 | 453 | 106-147 | 455 | 196-291 | 457 | 307-339 | 459 | 340-1329 | 460 |
| Ab11A.H | 1-90 | 493 | 106-147 | 495 | 196-291 | 497 | 307-339 | 499 | 340-1329 | 500 |
| Ab12.H | 1-90 | 533 | 106-147 | 535 | 196-291 | 537 | 307-339 | 539 | 340-1329 | 540 |
| Ab13.H | 1-90 | 573 | 109-150 | 575 | 202-297 | 577 | 313-345 | 579 | 346-1335 | 580 |
| Ab15.H | 1-90 | 613 | 109-150 | 615 | 202-297 | 617 | 313-345 | 619 | 346-1335 | 620 |
| Ab17.H | 1-90 | 653 | 109-150 | 655 | 202-297 | 657 | 313-345 | 659 | 346-1335 | 660 |

FIG. 11A
Antibody Light chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab13 | 1-333 | 32 | 70-102 | 34 | 148-168 | 36 | 265-300 | 38 |
| Ab15 | 1-333 | 72 | 70-102 | 74 | 148-168 | 76 | 265-300 | 78 |
| Ab17 | 1-333 | 112 | 70-102 | 114 | 148-168 | 116 | 265-300 | 118 |
| Ab1.H | 1-339 | 152 | 70-102 | 154 | 148-168 | 156 | 265-306 | 158 |
| Ab2.H | 1-339 | 192 | 70-102 | 194 | 148-168 | 196 | 265-306 | 198 |
| Ab3.H | 1-339 | 232 | 70-102 | 234 | 148-168 | 236 | 265-306 | 238 |
| Ab4.H | 1-339 | 272 | 70-102 | 274 | 148-168 | 276 | 265-306 | 278 |
| Ab6.H | 1-339 | 312 | 70-102 | 314 | 148-168 | 316 | 265-306 | 318 |
| Ab7.H | 1-339 | 352 | 70-102 | 354 | 148-168 | 356 | 265-306 | 358 |
| Ab7A.H | 1-342 | 392 | 73-105 | 394 | 151-171 | 396 | 268-309 | 398 |
| Ab10.H | 1-339 | 432 | 70-102 | 434 | 148-168 | 436 | 265-306 | 438 |
| Ab11.H | 1-339 | 472 | 70-102 | 474 | 148-168 | 476 | 265-306 | 478 |
| Ab11A.H | 1-339 | 512 | 70-102 | 514 | 148-168 | 516 | 265-306 | 518 |
| Ab12.H | 1-339 | 552 | 70-102 | 554 | 148-168 | 556 | 265-306 | 558 |
| Ab13.H | 1-333 | 592 | 70-102 | 594 | 148-168 | 596 | 265-300 | 598 |
| Ab15.H | 1-333 | 632 | 70-102 | 634 | 148-168 | 636 | 265-300 | 638 |
| Ab17.H | 1-333 | 672 | 70-102 | 674 | 148-168 | 676 | 265-300 | 678 |

FIG. 11B
Antibody Light chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-339 | 712 | 70-102 | 714 | 148-168 | 716 | 265-306 | 718 |
| Ab2 | 1-339 | 752 | 70-102 | 754 | 148-168 | 756 | 265-306 | 758 |
| Ab3 | 1-339 | 792 | 70-102 | 794 | 148-168 | 796 | 265-306 | 798 |
| Ab4 | 1-339 | 832 | 70-102 | 834 | 148-168 | 836 | 265-306 | 838 |
| Ab5 | 1-342 | 872 | 73-105 | 874 | 151-171 | 876 | 268-309 | 878 |
| Ab6 | 1-342 | 912 | 73-105 | 914 | 151-171 | 916 | 268-309 | 918 |
| Ab7 | 1-342 | 952 | 73-105 | 954 | 151-171 | 956 | 268-309 | 958 |
| Ab9 | 1-342 | 992 | 73-105 | 994 | 151-171 | 996 | 268-309 | 998 |
| Ab10 | 1-339 | 1032 | 70-102 | 1034 | 148-168 | 1036 | 265-306 | 1038 |
| Ab11 | 1-339 | 1072 | 70-102 | 1074 | 148-168 | 1076 | 265-306 | 1078 |
| Ab12 | 1-339 | 1112 | 70-102 | 1114 | 148-168 | 1116 | 265-306 | 1118 |

FIG. 12B
Antibody Light chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab1 | 1-69 | 713 | 103-147 | 715 | 169-264 | 717 | 307-339 | 719 | 340-657 | 720 |
| Ab2 | 1-69 | 753 | 103-147 | 755 | 169-264 | 757 | 307-339 | 759 | 340-657 | 760 |
| Ab3 | 1-69 | 793 | 103-147 | 795 | 169-264 | 797 | 307-339 | 799 | 340-657 | 800 |
| Ab4 | 1-69 | 833 | 103-147 | 835 | 169-264 | 837 | 307-339 | 839 | 340-657 | 840 |
| Ab5 | 1-72 | 873 | 106-150 | 875 | 172-267 | 877 | 310-342 | 879 | 343-660 | 880 |
| Ab6 | 1-72 | 913 | 106-150 | 915 | 172-267 | 917 | 310-342 | 919 | 343-660 | 920 |
| Ab7 | 1-72 | 953 | 106-150 | 955 | 172-267 | 957 | 310-342 | 959 | 343-660 | 960 |
| Ab9 | 1-72 | 993 | 106-150 | 995 | 172-267 | 997 | 310-342 | 999 | 343-660 | 1000 |
| Ab10 | 1-69 | 1033 | 103-147 | 1035 | 169-264 | 1037 | 307-339 | 1039 | 340-657 | 1040 |
| Ab11 | 1-69 | 1073 | 103-147 | 1075 | 169-264 | 1077 | 307-339 | 1079 | 340-657 | 1080 |
| Ab12 | 1-69 | 1113 | 103-147 | 1115 | 169-264 | 1117 | 307-339 | 1119 | 340-657 | 1120 |

FIG. 12A
Antibody Light chain DNA features

| Sequence Name | FR1 coordinates | SEQ ID NO: | FR2 coordinates | SEQ ID NO: | FR3 coordinates | SEQ ID NO: | FR4 coordinates | SEQ ID NO: | Constant region coordinates | SEQ ID NO: |
|---|---|---|---|---|---|---|---|---|---|---|
| Ab13 | 1-69 | 33 | 103-147 | 35 | 169-264 | 37 | 301-333 | 39 | 334-651 | 40 |
| Ab15 | 1-69 | 73 | 103-147 | 75 | 169-264 | 77 | 301-333 | 79 | 334-651 | 80 |
| Ab17 | 1-69 | 113 | 103-147 | 115 | 169-264 | 117 | 301-333 | 119 | 334-651 | 120 |
| Ab1.H | 1-69 | 153 | 103-147 | 155 | 169-264 | 157 | 307-339 | 159 | 340-657 | 160 |
| Ab2.H | 1-69 | 193 | 103-147 | 195 | 169-264 | 197 | 307-339 | 199 | 340-657 | 200 |
| Ab3.H | 1-69 | 233 | 103-147 | 235 | 169-264 | 237 | 307-339 | 239 | 340-657 | 240 |
| Ab4.H | 1-69 | 273 | 103-147 | 275 | 169-264 | 277 | 307-339 | 279 | 340-657 | 280 |
| Ab6.H | 1-69 | 313 | 103-147 | 315 | 169-264 | 317 | 307-339 | 319 | 340-657 | 320 |
| Ab7.H | 1-69 | 353 | 103-147 | 355 | 169-264 | 357 | 307-339 | 359 | 340-657 | 360 |
| Ab7A.H | 1-72 | 393 | 106-150 | 395 | 172-267 | 397 | 310-342 | 399 | 343-660 | 400 |
| Ab10.H | 1-69 | 433 | 103-147 | 435 | 169-264 | 437 | 307-339 | 439 | 340-657 | 440 |
| Ab11.H | 1-69 | 473 | 103-147 | 475 | 169-264 | 477 | 307-339 | 479 | 340-657 | 480 |
| Ab11A.H | 1-69 | 513 | 103-147 | 515 | 169-264 | 517 | 307-339 | 519 | 340-657 | 520 |
| Ab12.H | 1-69 | 553 | 103-147 | 555 | 169-264 | 557 | 307-339 | 559 | 340-657 | 560 |
| Ab13.H | 1-69 | 593 | 103-147 | 595 | 169-264 | 597 | 301-333 | 599 | 334-651 | 600 |
| Ab15.H | 1-69 | 633 | 103-147 | 635 | 169-264 | 637 | 301-333 | 639 | 334-651 | 640 |
| Ab17.H | 1-69 | 673 | 103-147 | 675 | 169-264 | 677 | 301-333 | 679 | 334-651 | 680 |

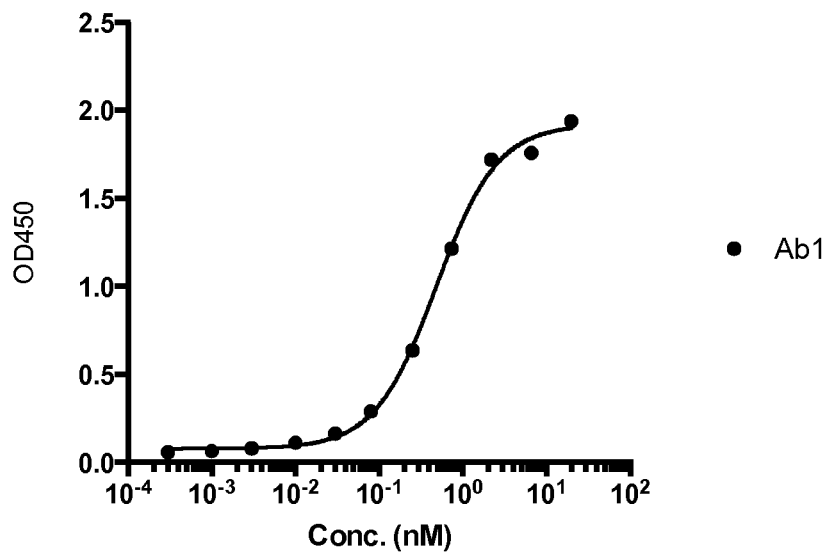
FIG. 13. Ab1 recognition of human ACTH.
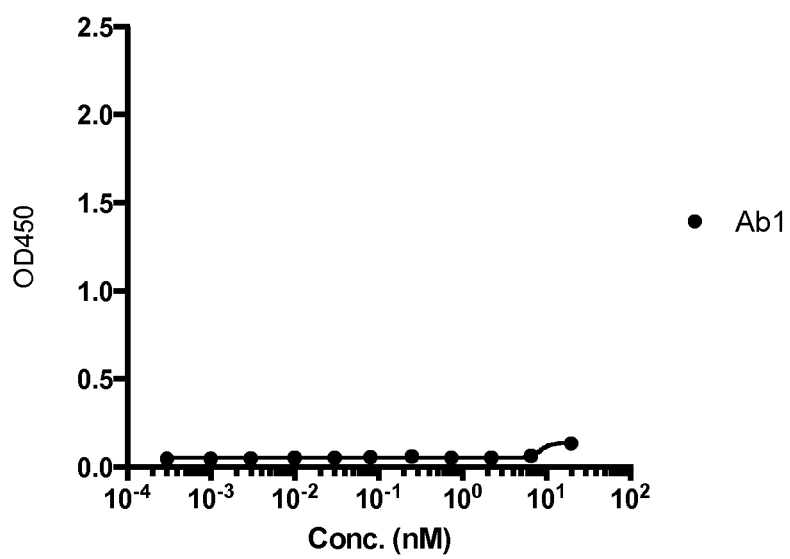
FIG. 14. Lack of recognition of human ACTH 1-13 and 18-39.

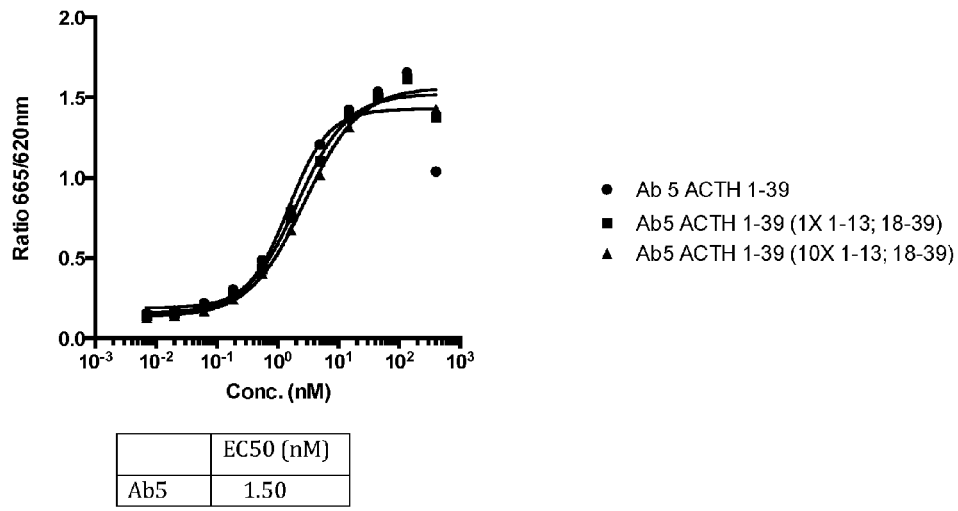
FIG. 15. Recognition of human ACTH 1-39 and lack of recognition of human ACTH 1-13 and 18-39.
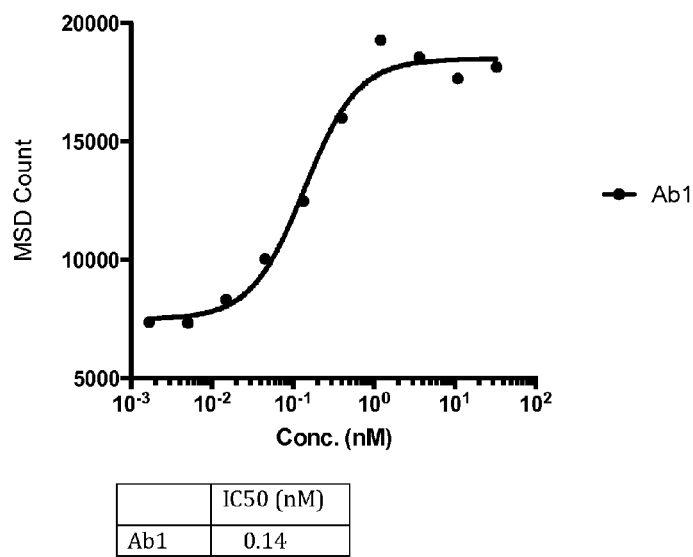
FIG. 16. Inhibition of ACTH driven cAMP production in MC2R expressing cells

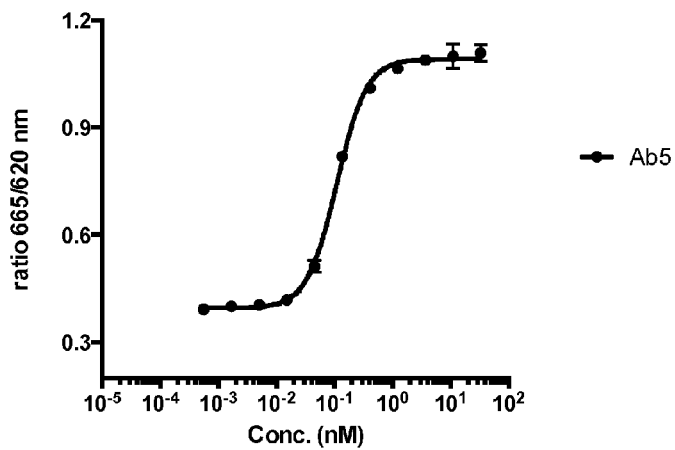
FIG. 17. Inhibition of ACTH driven cAMP production in MC2R expressing cells
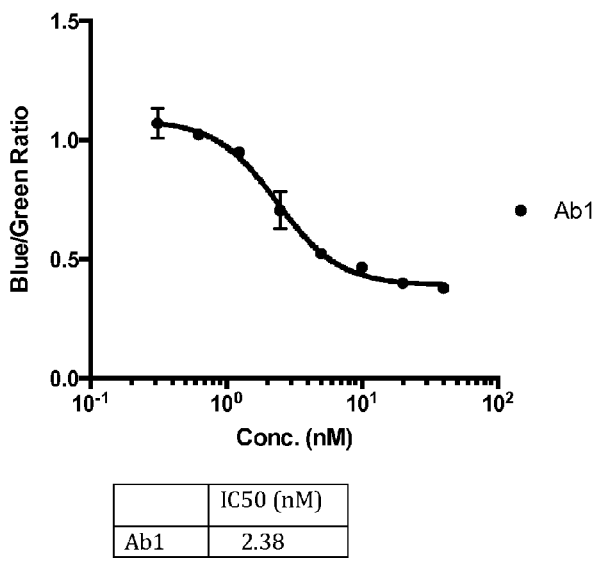
FIG. 18. Inhibition of ACTH driven cAMP production in MC1R expressing cells

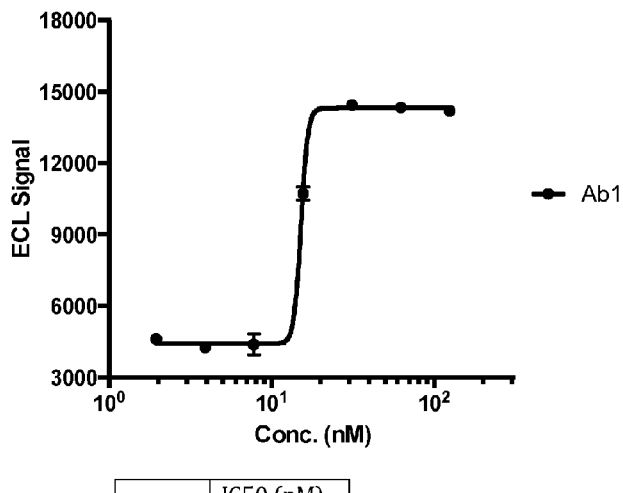
FIG. 19. Inhibition of ACTH driven cAMP production in MC3R expressing cells
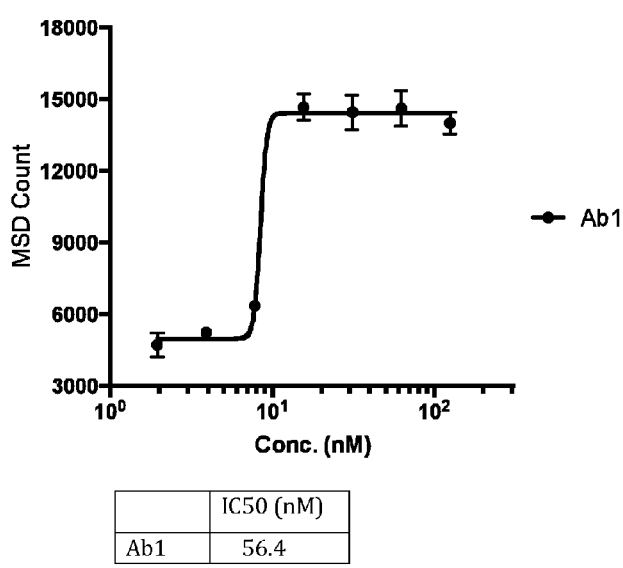
FIG. 20. Inhibition of ACTH driven cAMP production in MC4R expressing cells

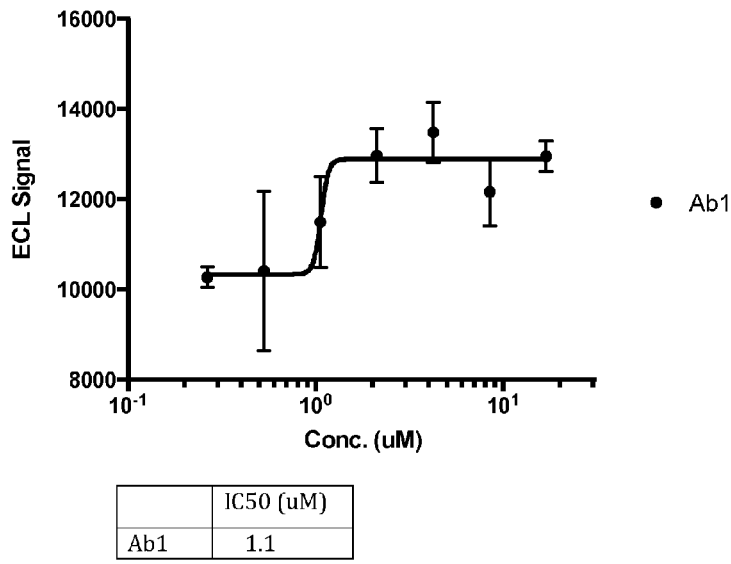
FIG. 21. Inhibition of ACTH driven cAMP production in MC5R expressing cells
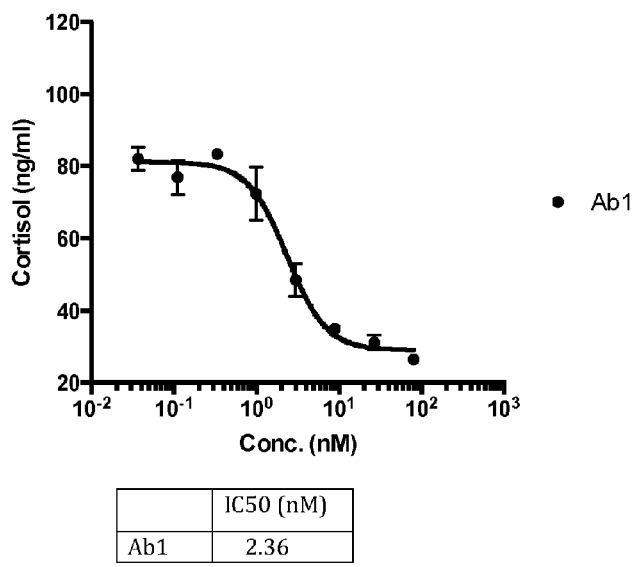
FIG. 22. Inhibition of ACTH driven cortisol production in Y1 cells

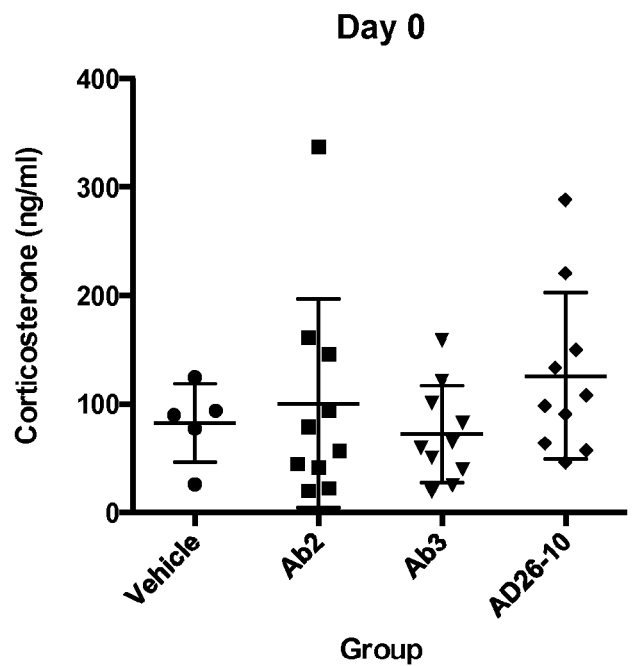
FIG. 23. Plasma corticosterone levels pre-dose
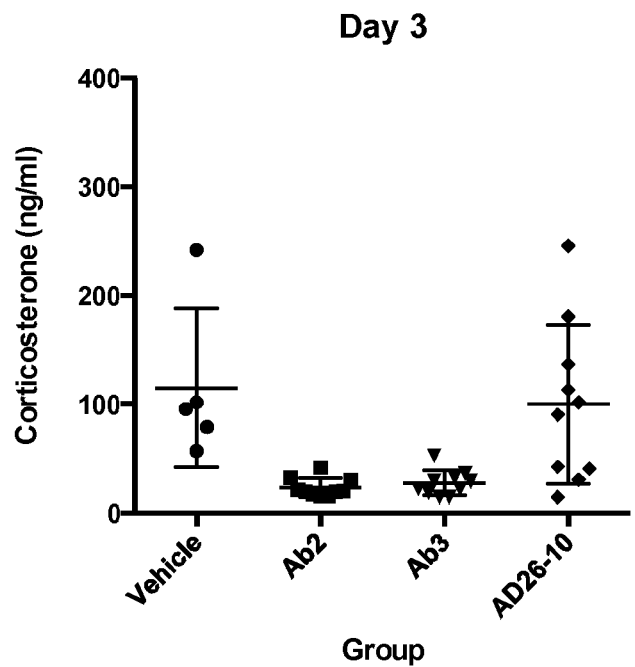
FIG. 24. Plasma corticosterone levels 48 hours post 1st dose

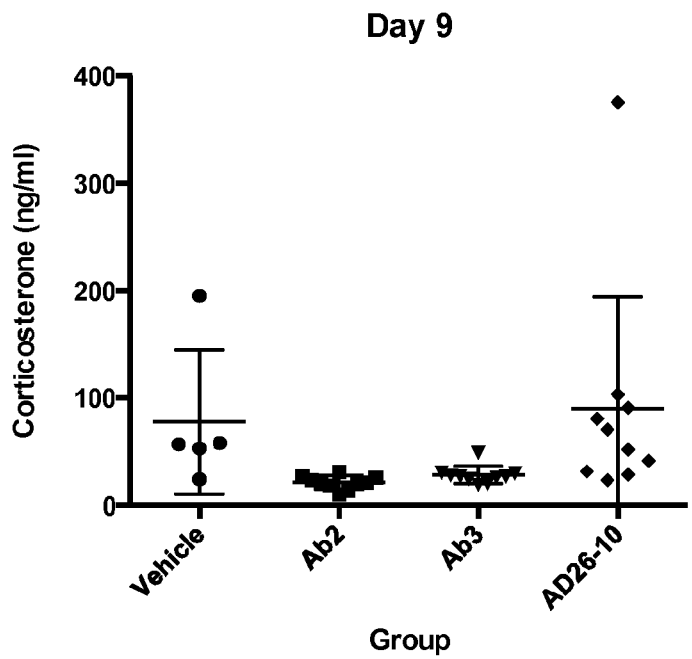
FIG. 25. Plasma corticosterone levels 48 hours post $2^{nd}$ dose
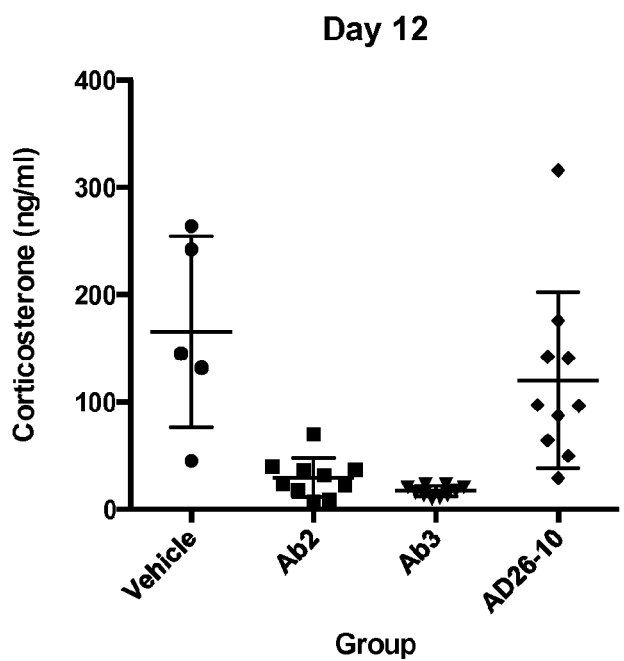
FIG. 26. Plasma corticosterone levels 120 hours post $2^{nd}$ dose

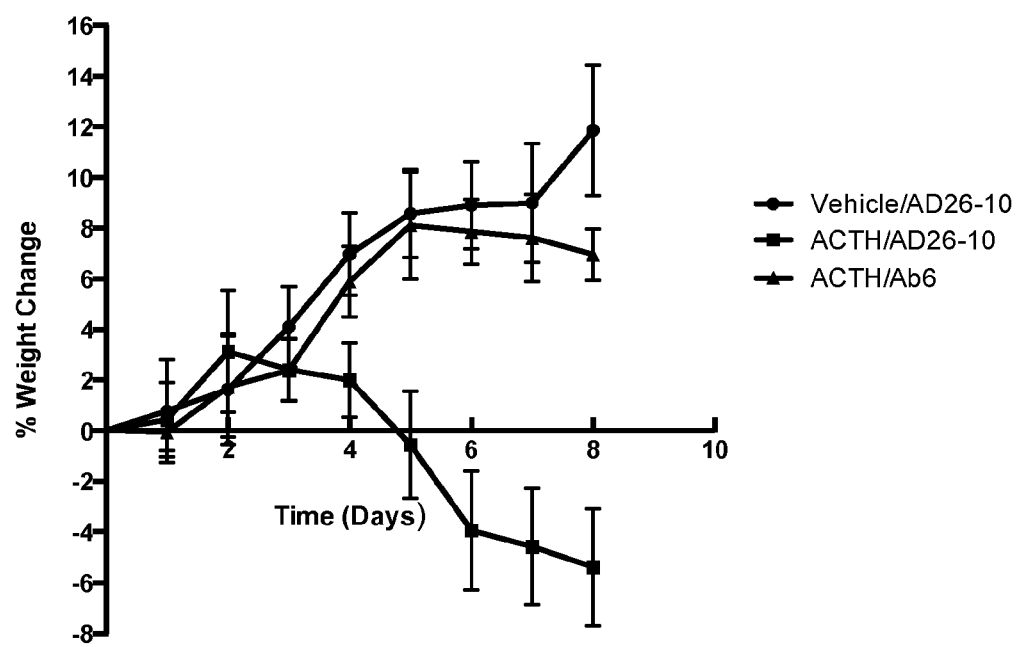
ANOVA Day 8: Vehicle/AD26-10 to ACTH/AD26-10 = <0.0001
ANOVA Day 8: ACTH/Ab6 to ACTH/AD26-10 = <0.0001
FIG. 27. Percent change in animal weight

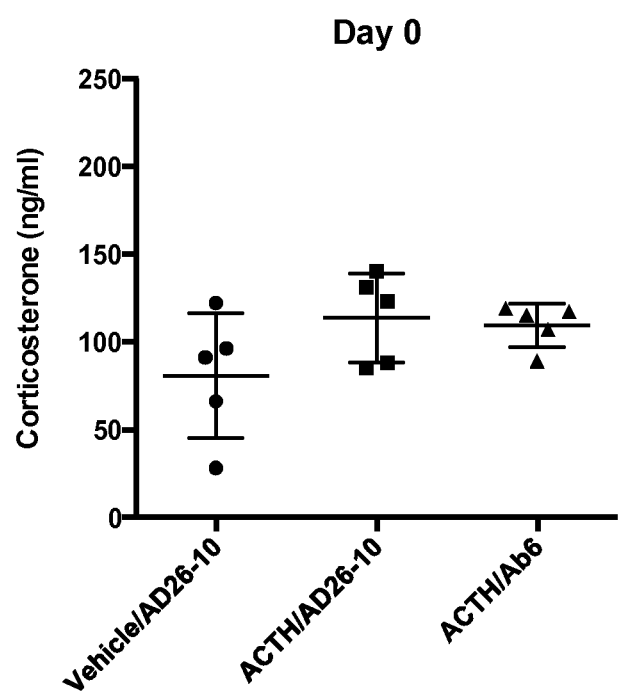
FIG. 28. Plasma corticosterone levels pre-ACTH and Ab dose

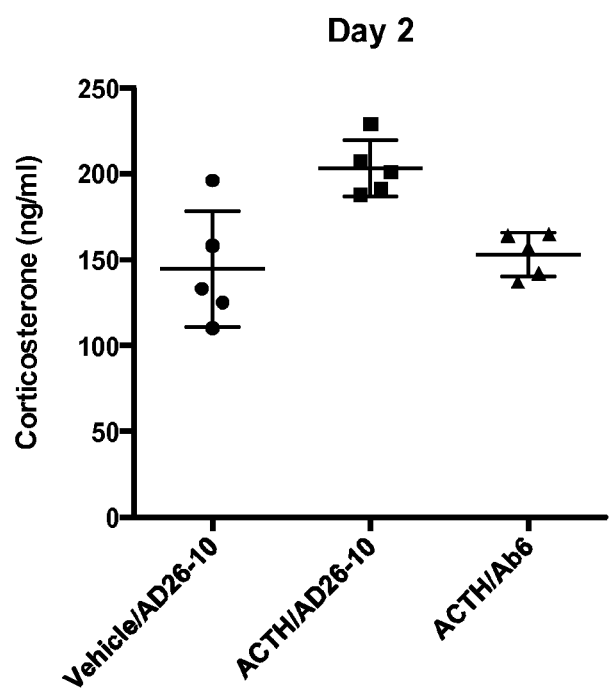
FIG. 29. Plasma corticosterone levels 24 hours post initiation of ACTH dosing and pre-Ab dose

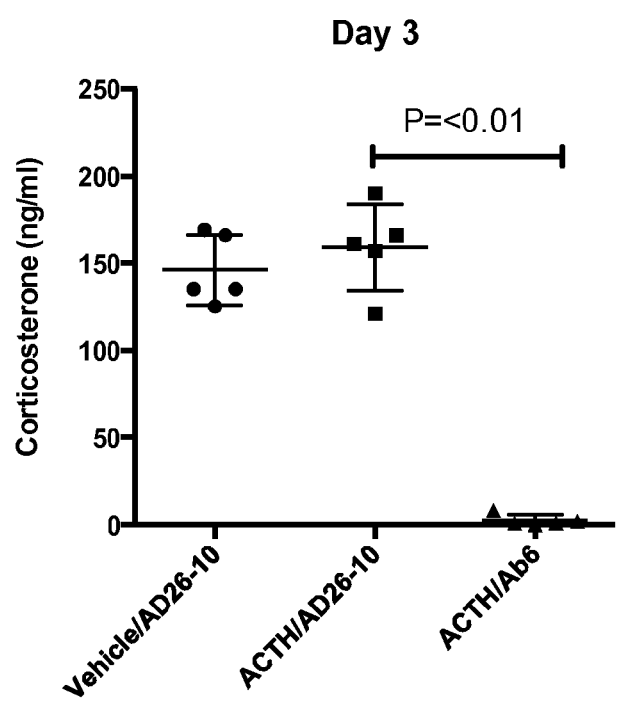
FIG. 30. Plasma corticosterone levels 48 hours post initiation of ACTH dosing and 24 hours post Ab dose

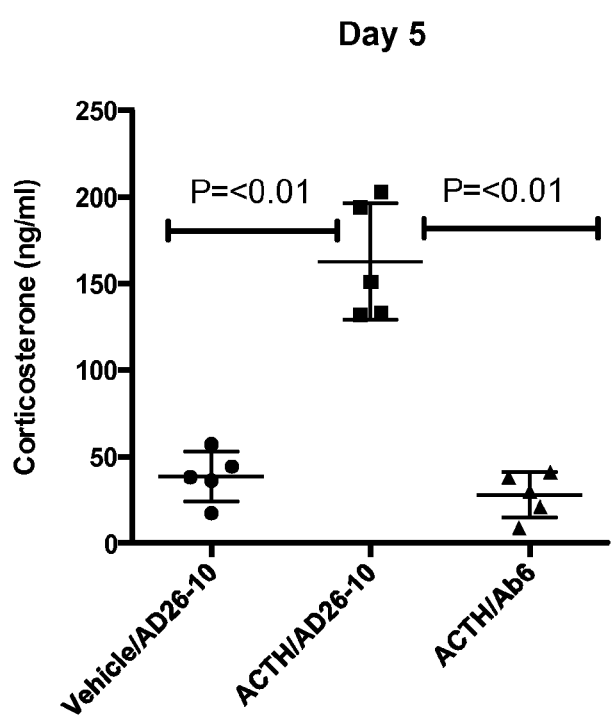
FIG. 31. Plasma corticosterone levels 96 hours post initiation of ACTH dosing and 72 hours post Ab dose

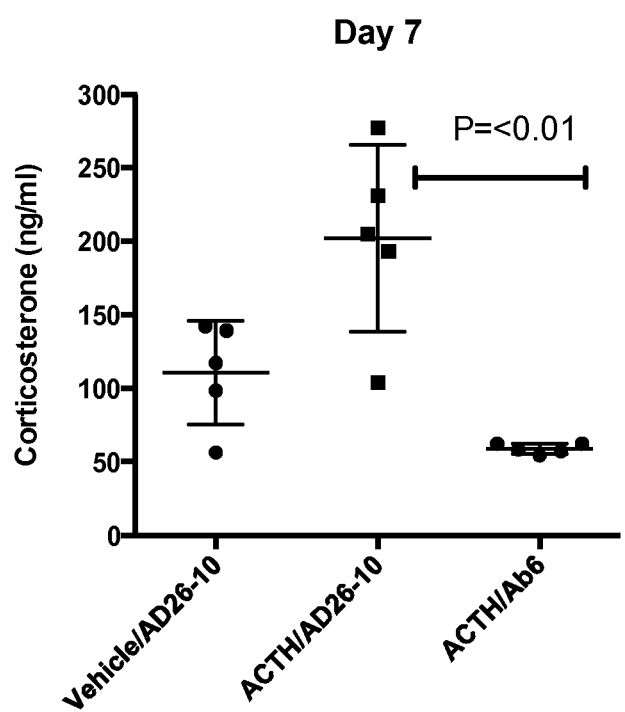
FIG. 32. Plasma corticosterone levels 144 hours post initiation of ACTH dosing and 120 hours post Ab dose

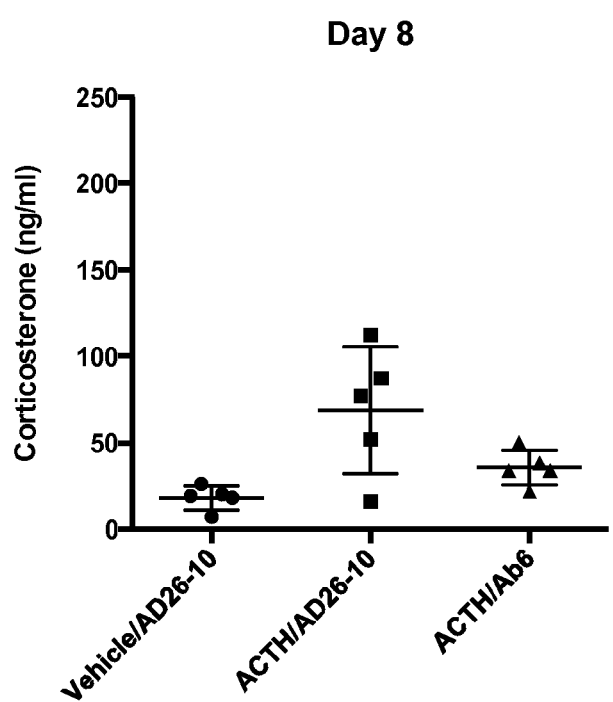
FIG. 33. Plasma corticosterone levels 168 hours post initiation of ACTH dosing and 144 hours post Ab dose

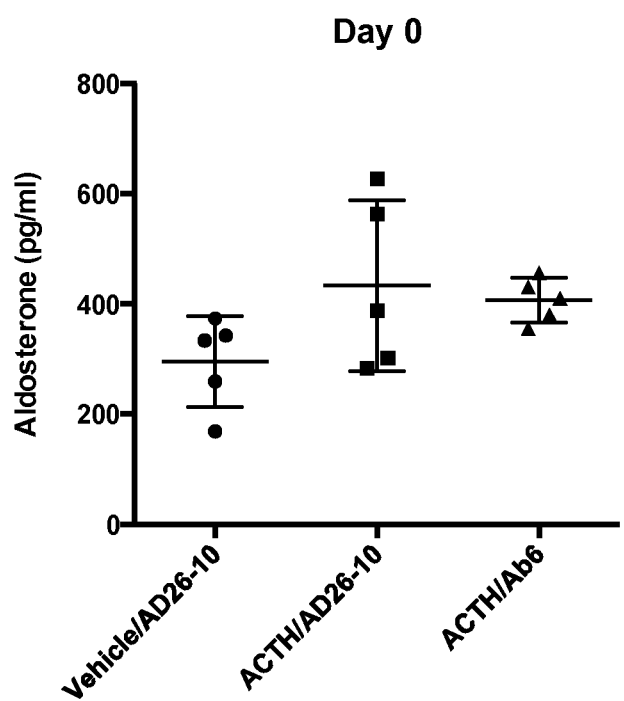
FIG. 34. Plasma aldosterone levels pre-ACTH and Ab dose

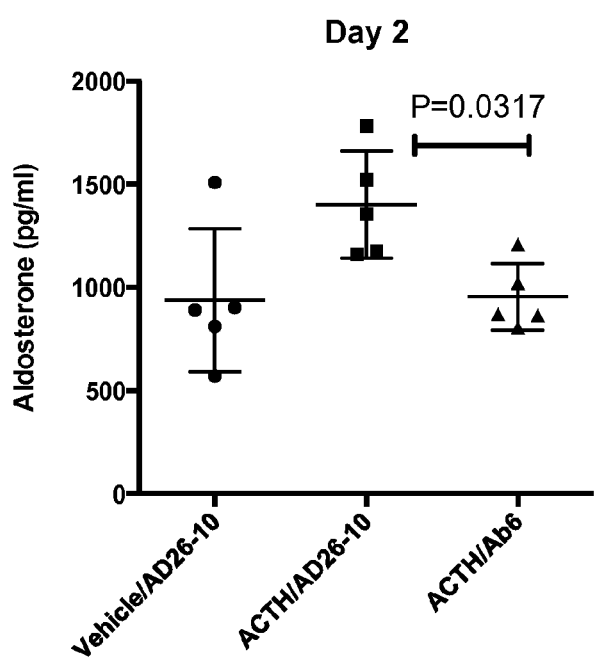
FIG. 35. Plasma aldosterone levels 24 hours post initiation of ACTH dosing and pre-Ab dose

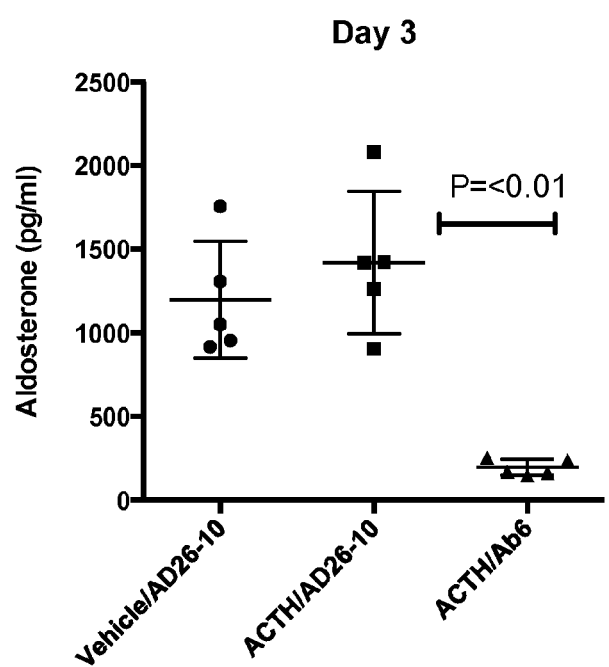
FIG. 36. Plasma aldosterone levels 48 hours post initiation of ACTH dosing and 24 hours post Ab dose

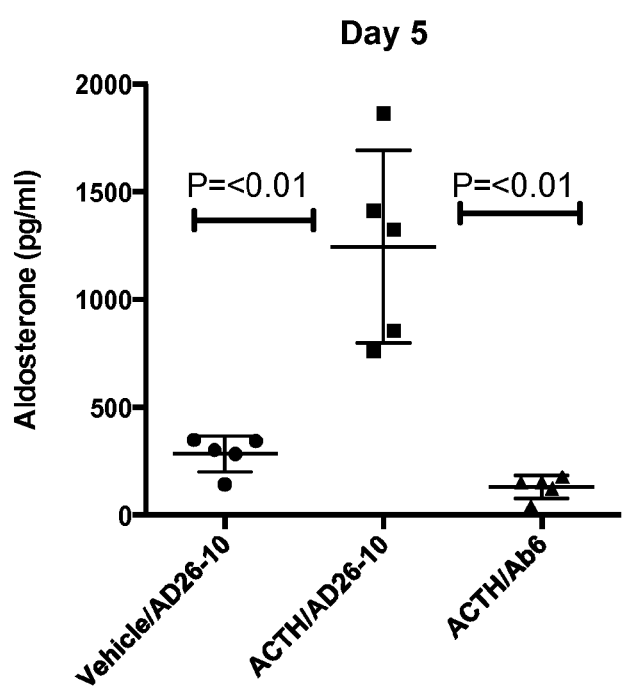
FIG. 37. Plasma aldosterone levels 96 hours post initiation of ACTH dosing and 72 hours post Ab dose

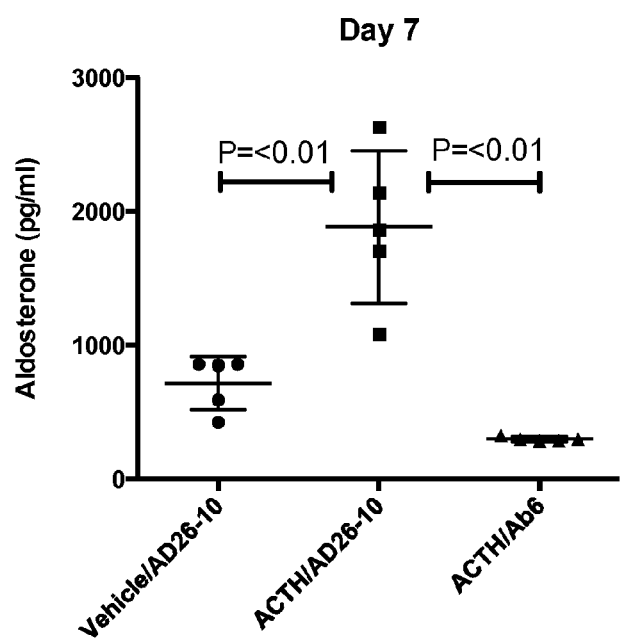
FIG. 38. Plasma aldosterone levels 144 hours post initiation of ACTH dosing and 120 hours post Ab dose

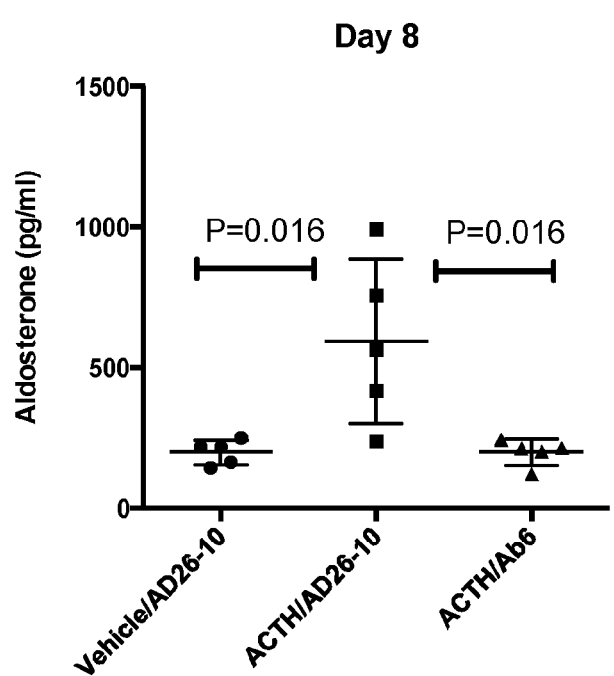
FIG. 39. Plasma aldosterone levels 168 hours post initiation of ACTH dosing and 144 hours post Ab dose

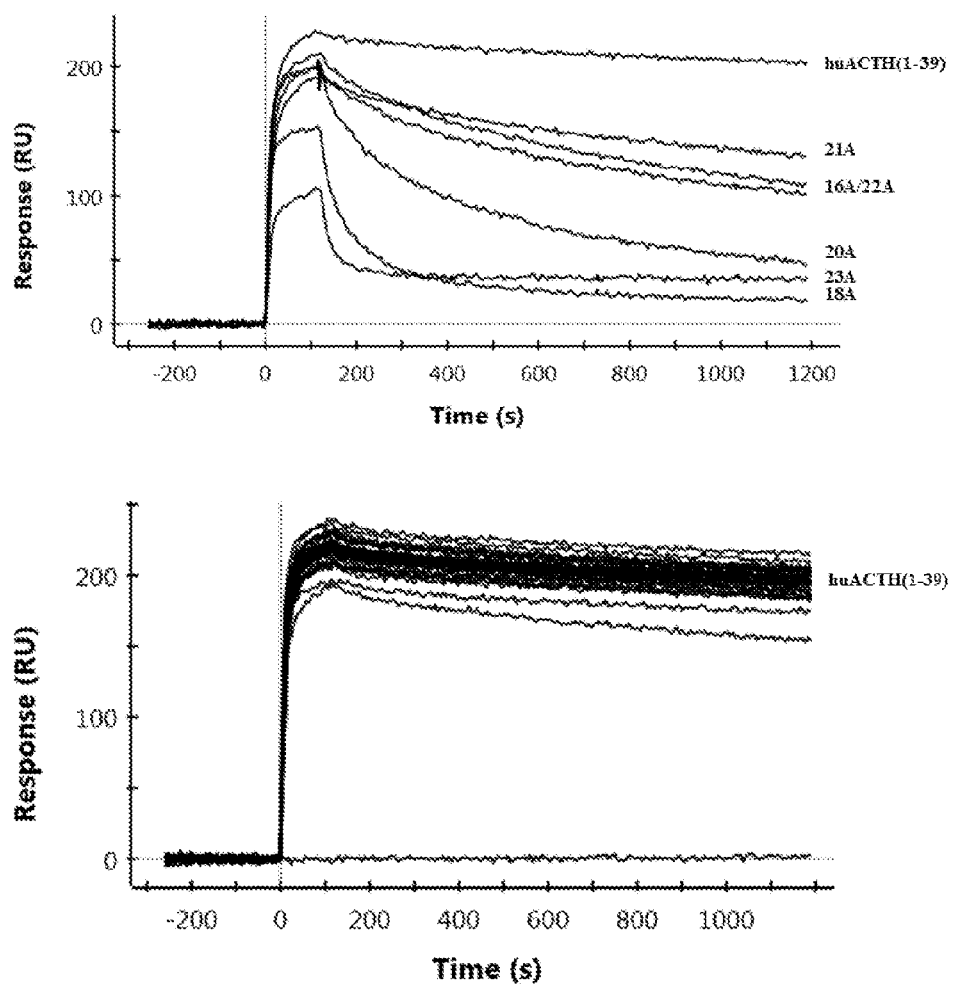
FIG. 40A. Binding kinetics of Ala mutants with Ab1.H

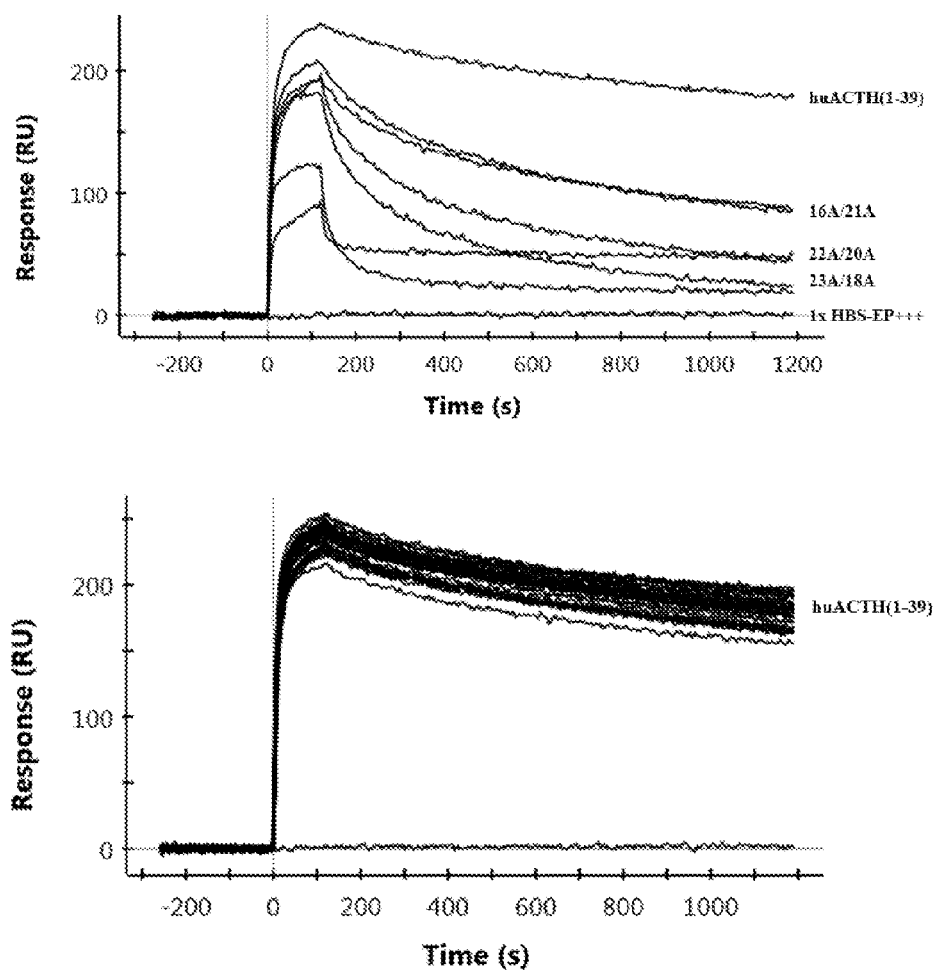
FIG. 40B. Binding kinetics of Ala mutants with Ab2.H

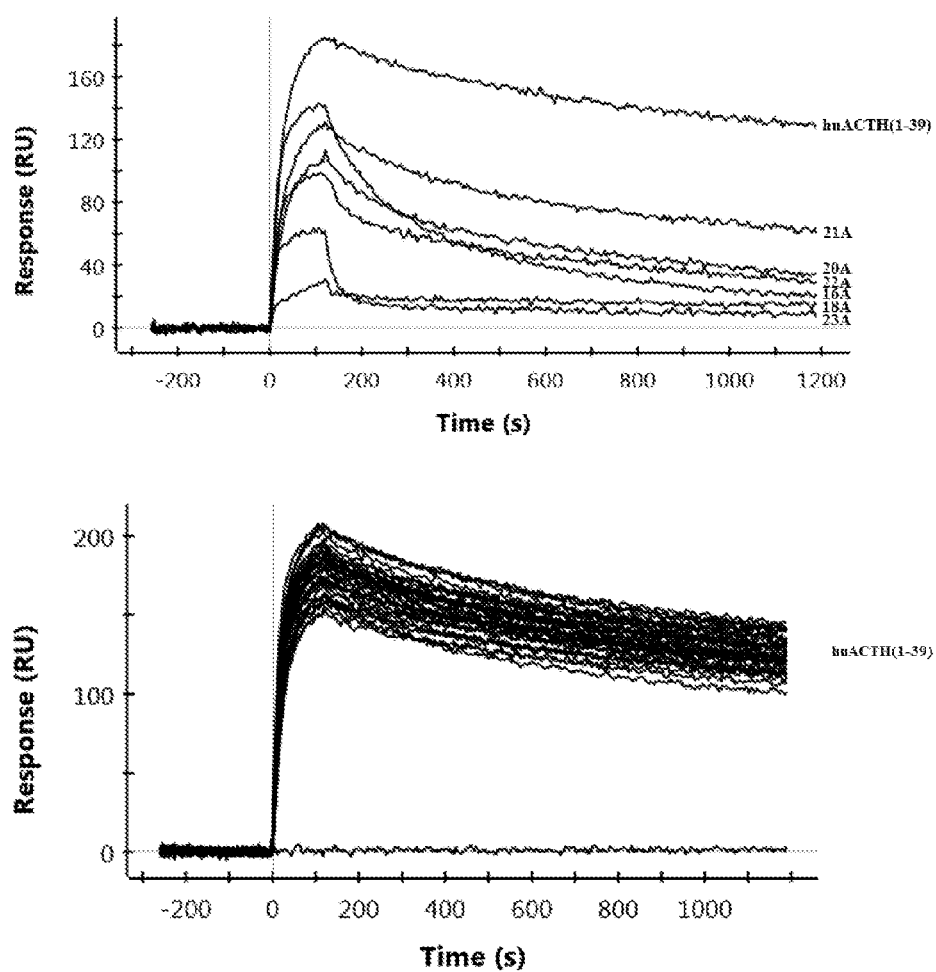
FIG. 40C. Binding kinetics of Ala mutants with Ab3.H

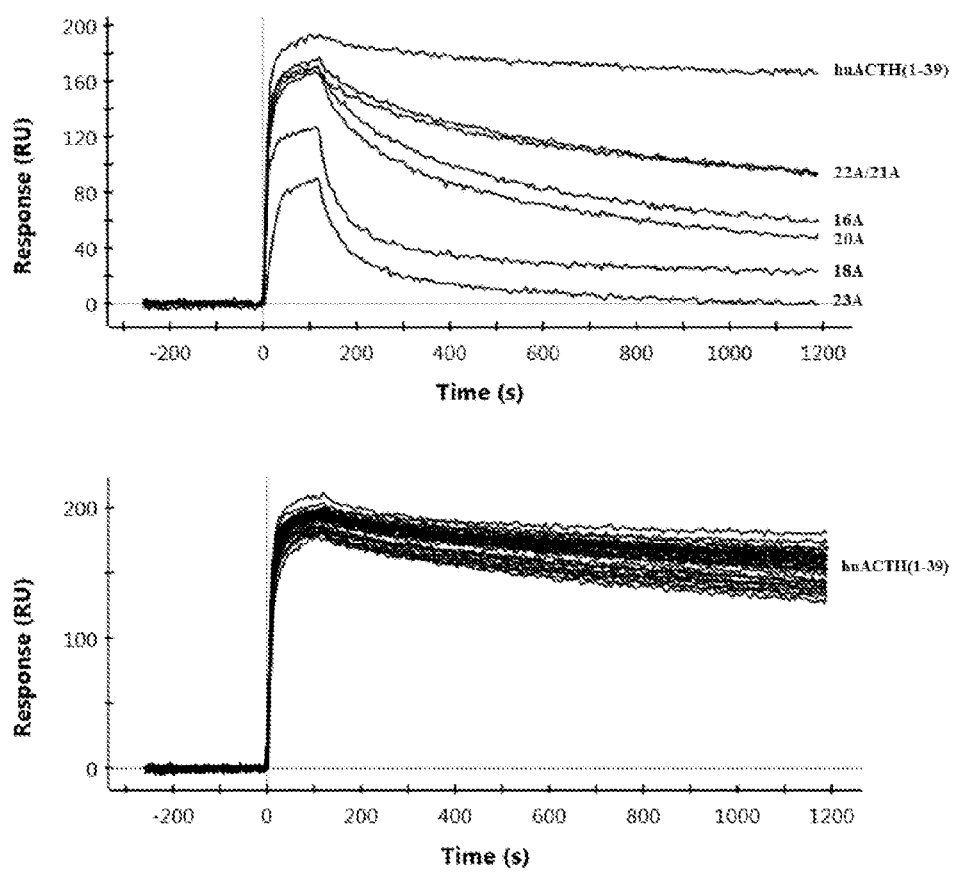
FIG. 40D. Binding kinetics of Ala mutants with Ab4.H

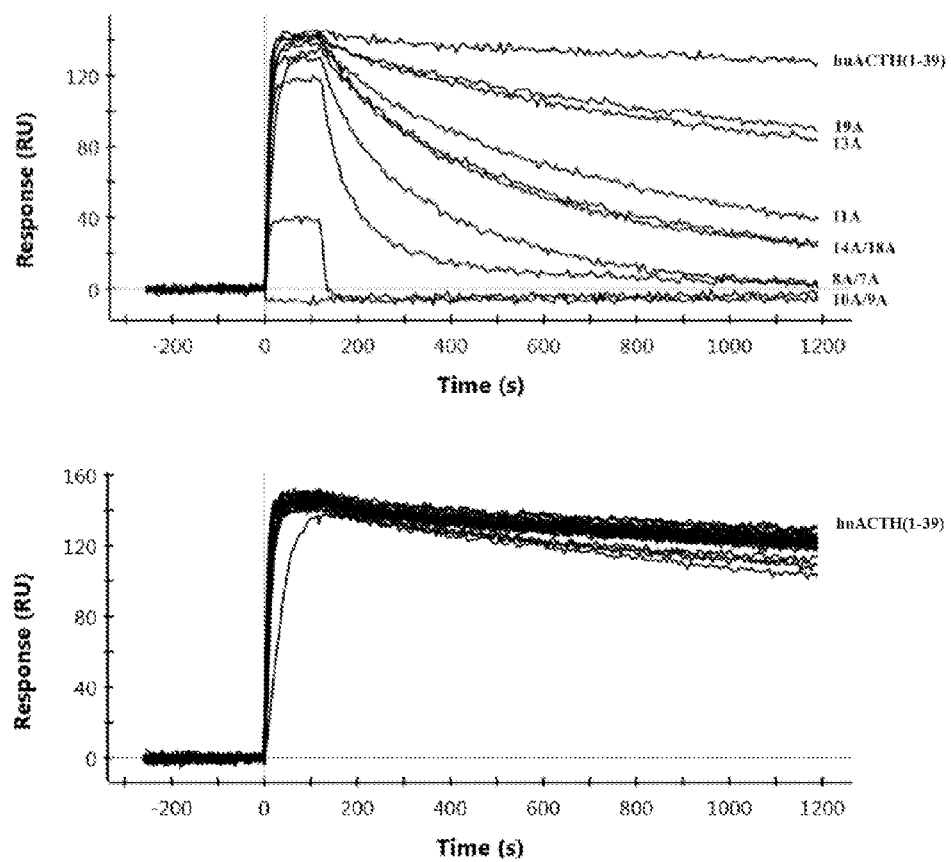
FIG. 40E. Binding kinetics of Ala mutants with Ab5

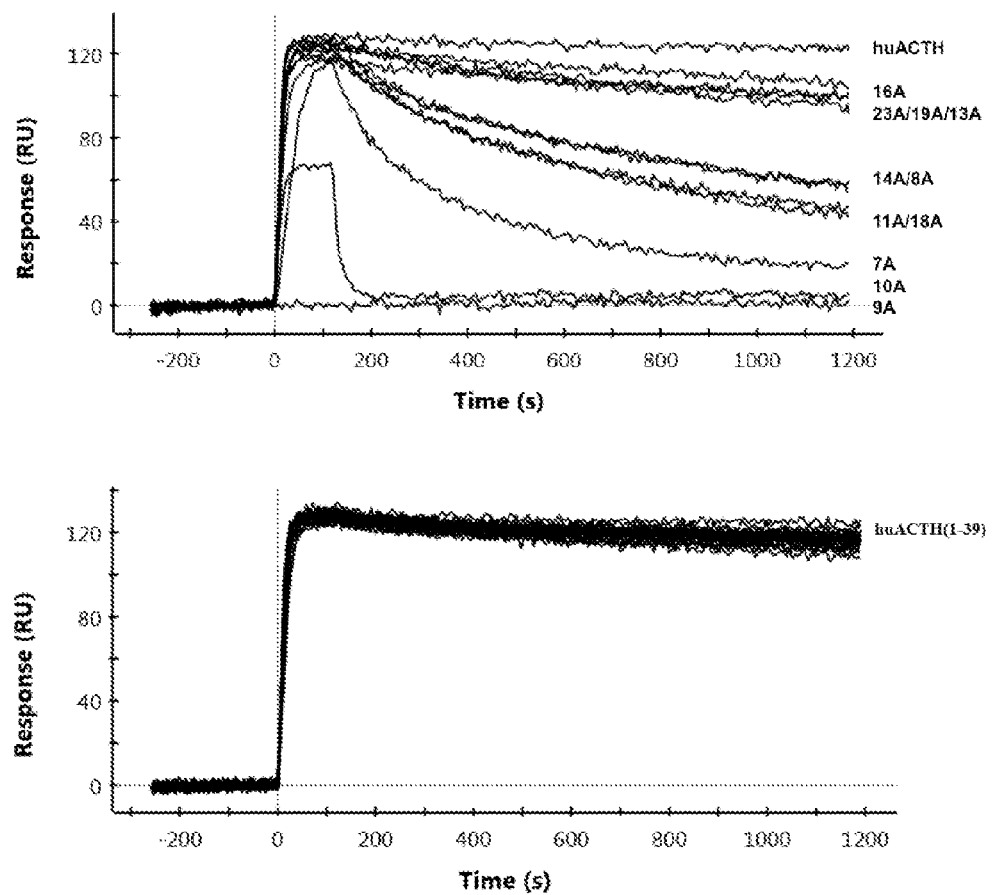
FIG. 40F. Binding kinetics of Ala mutants with Ab6.H

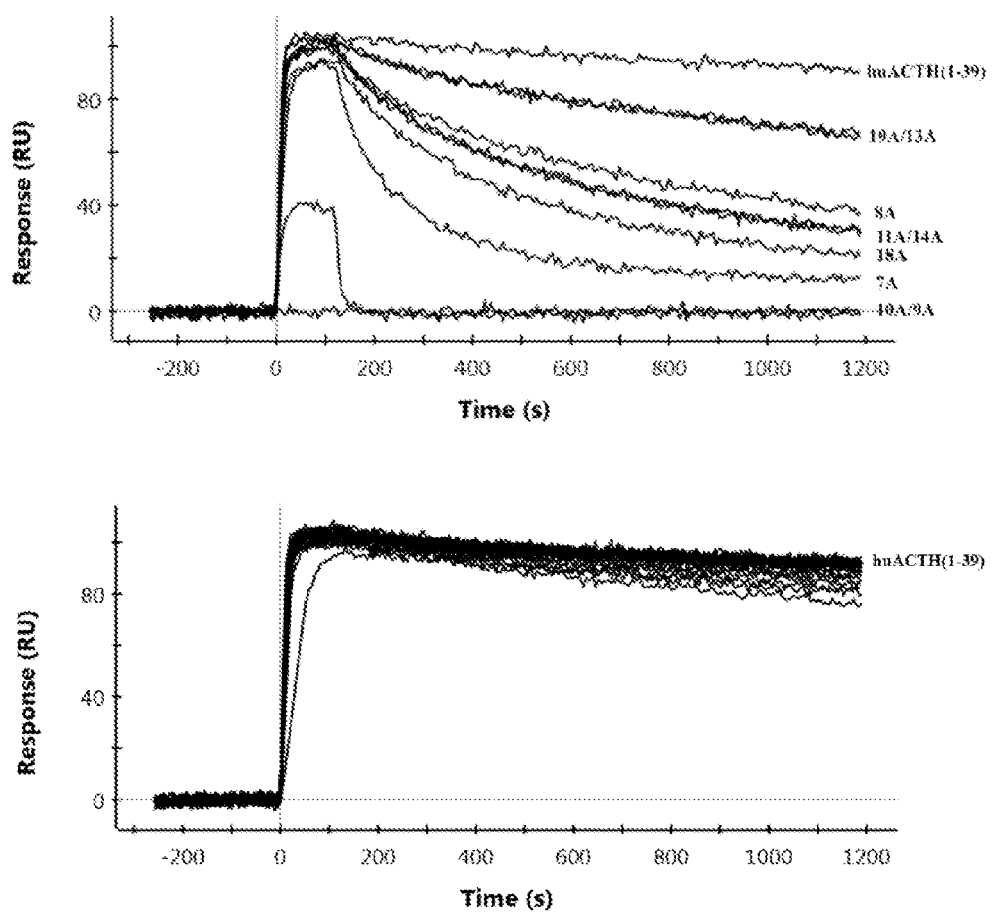
FIG. 40G. Binding kinetics of Ala mutants with Ab7.H

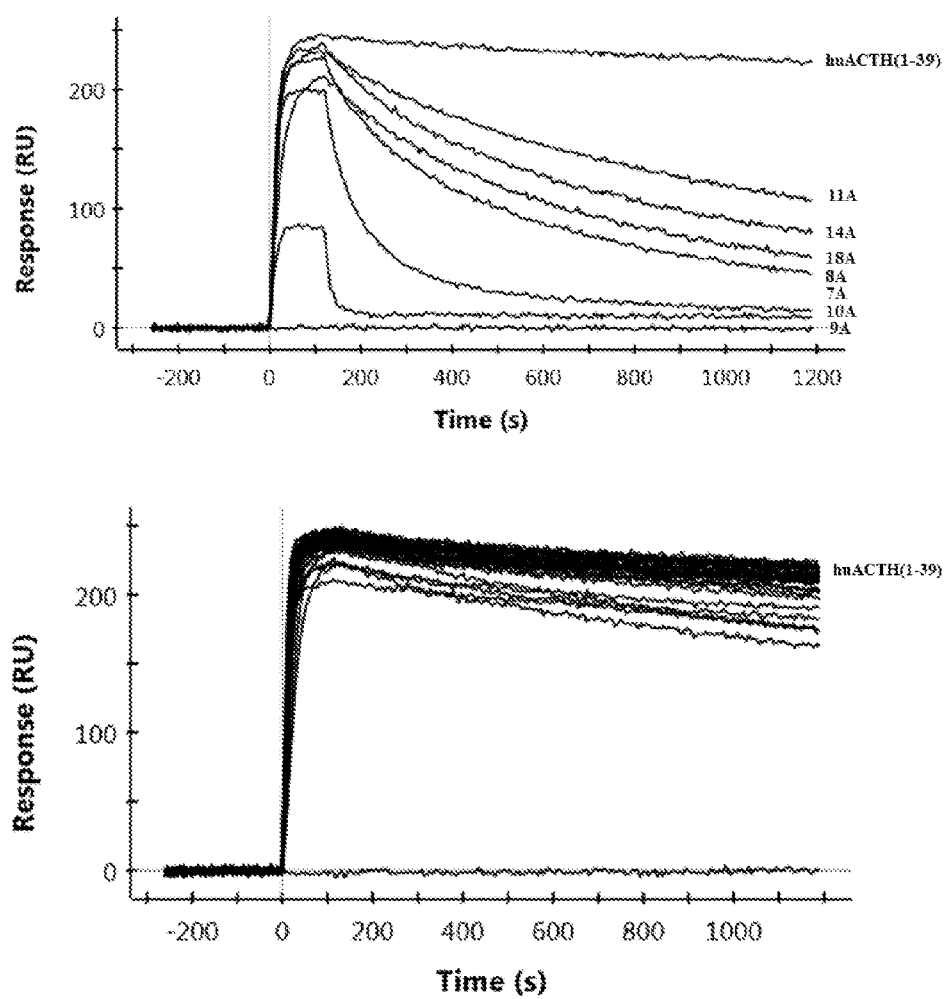
FIG. 40H. Binding kinetics of Ala mutants with Ab9

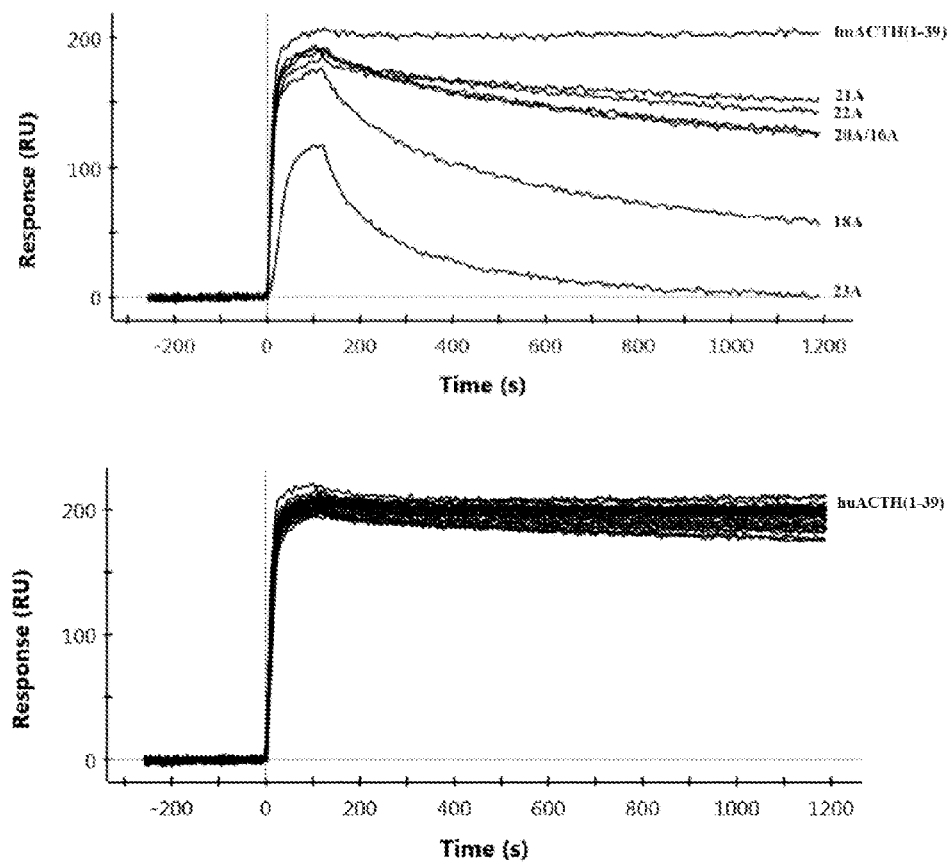
FIG. 40I. Binding kinetics of Ala mutants with Ab10.H

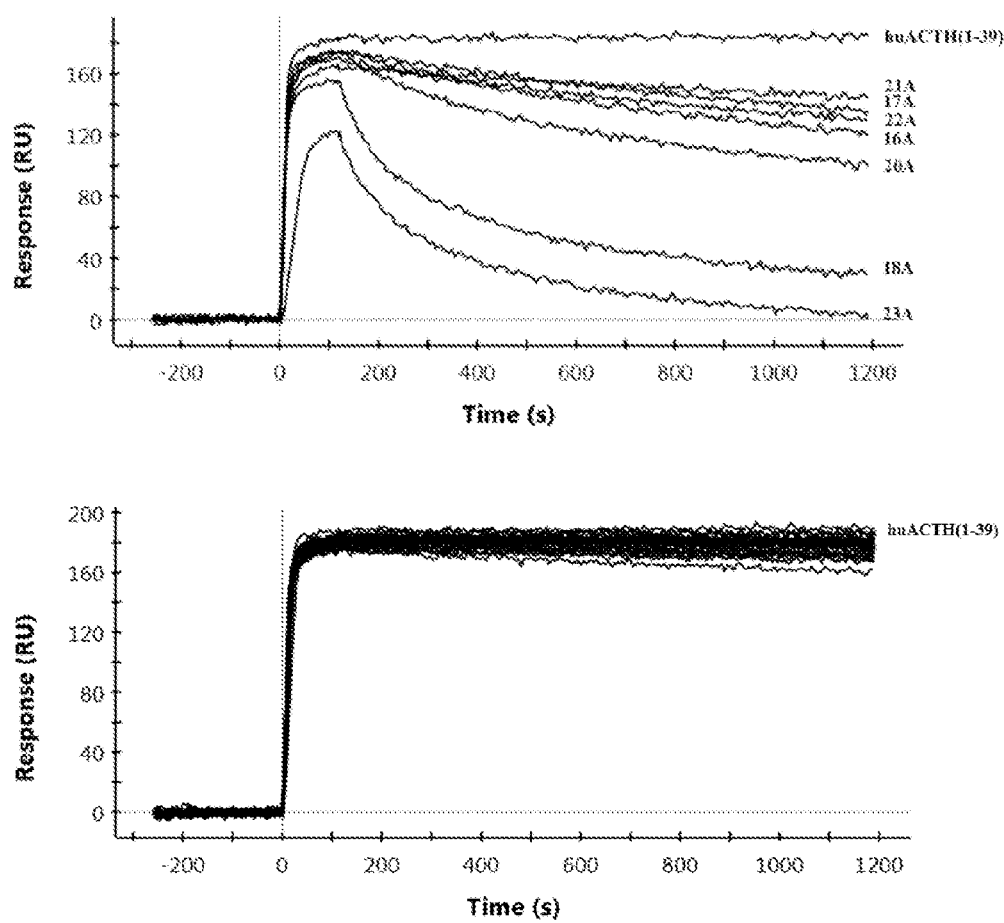
FIG. 40J. Binding kinetics of Ala mutants with Ab11.H

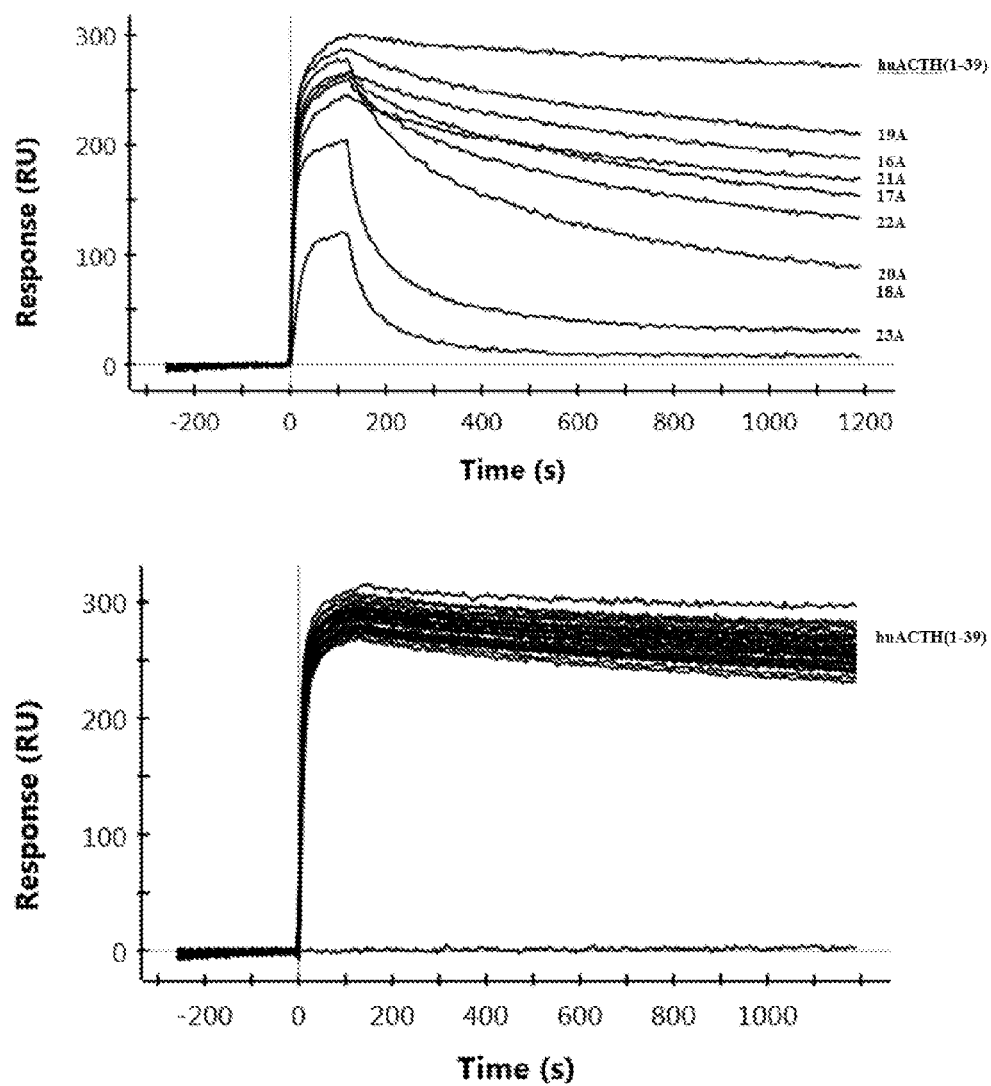
FIG. 40K. Binding kinetics of Ala mutants with Ab11A.H

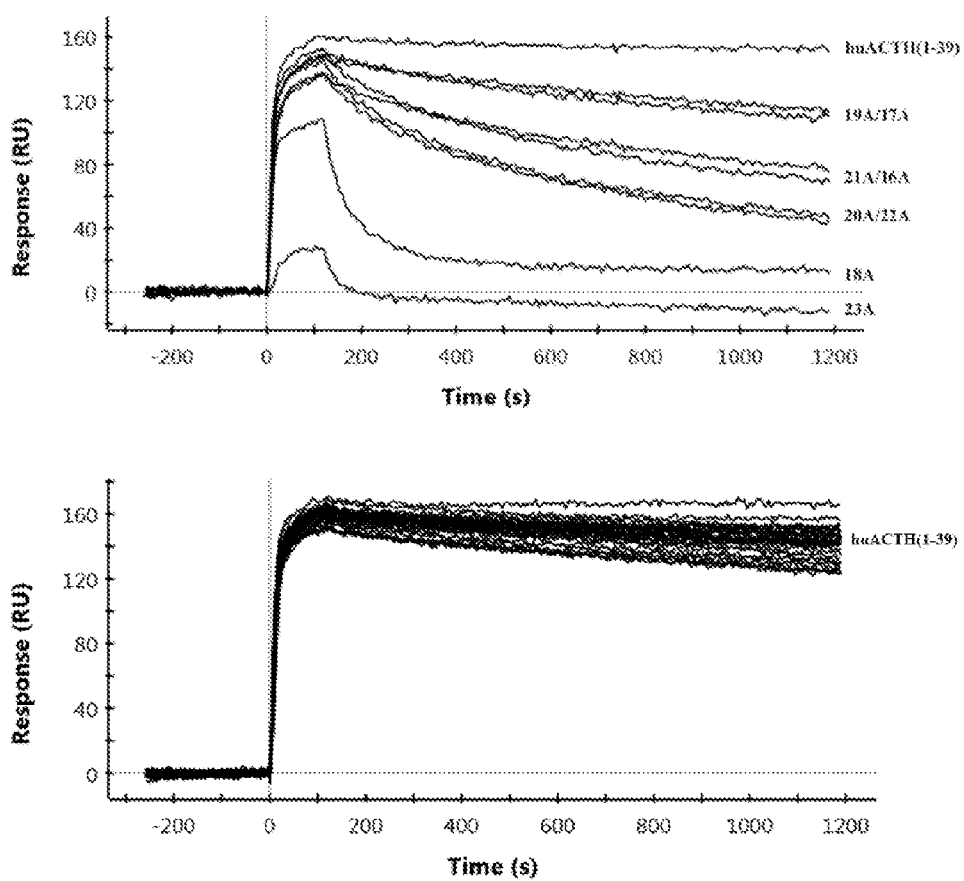
FIG. 40L. Binding kinetics of Ala mutants with Ab12.H

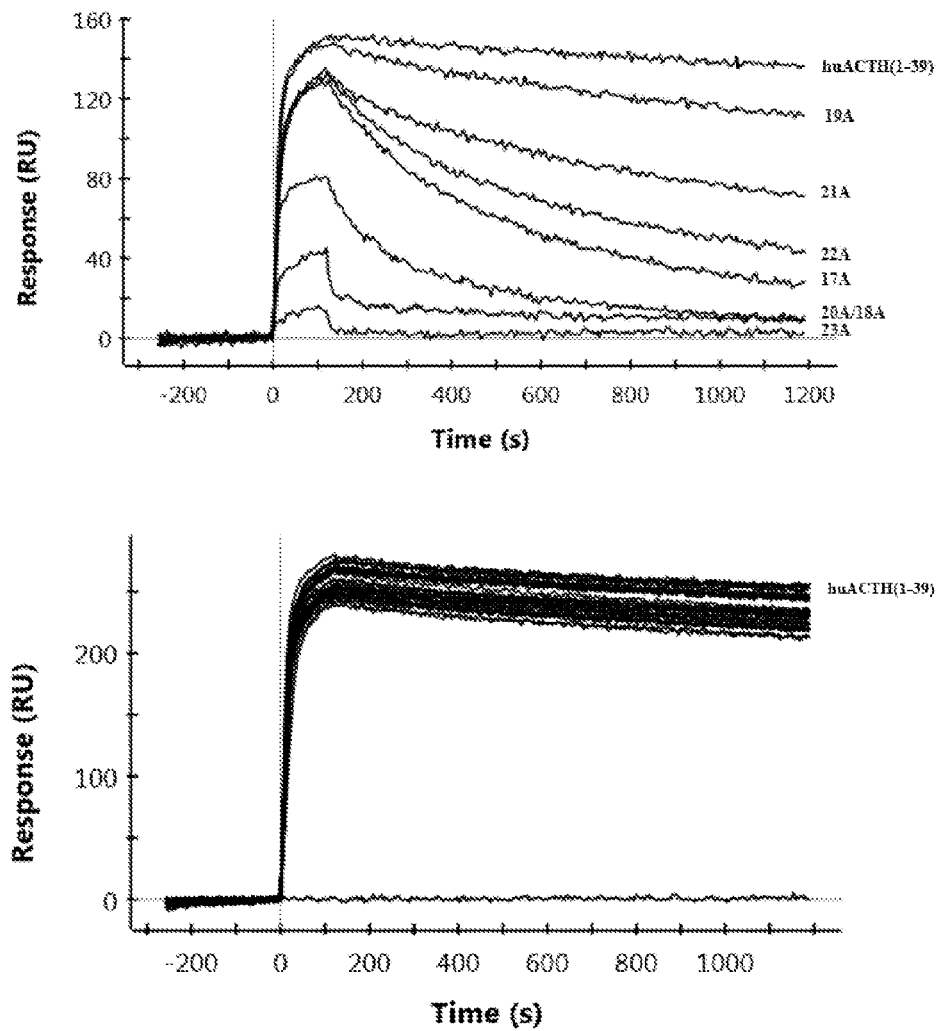
FIG. 40M. Binding kinetics of Ala mutants with Ab13.H

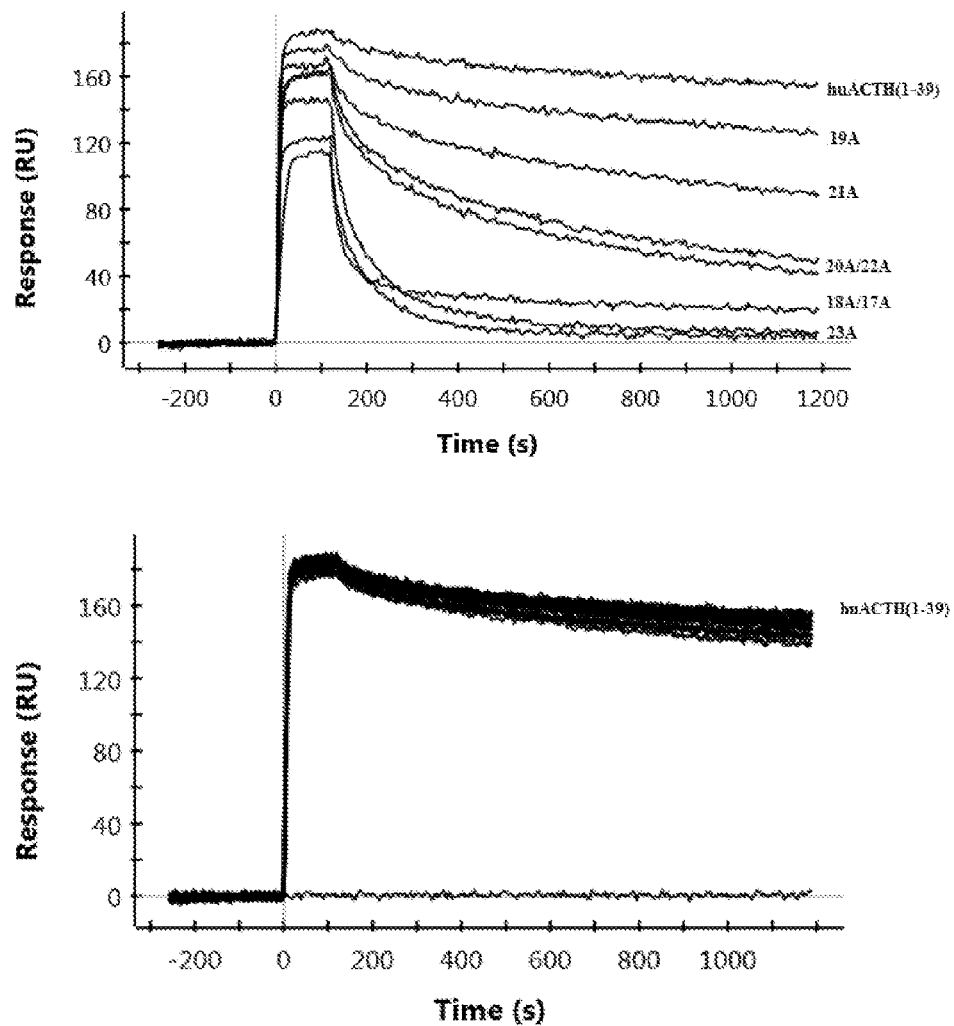
FIG. 40N. Binding kinetics of Ala mutants with Ab15

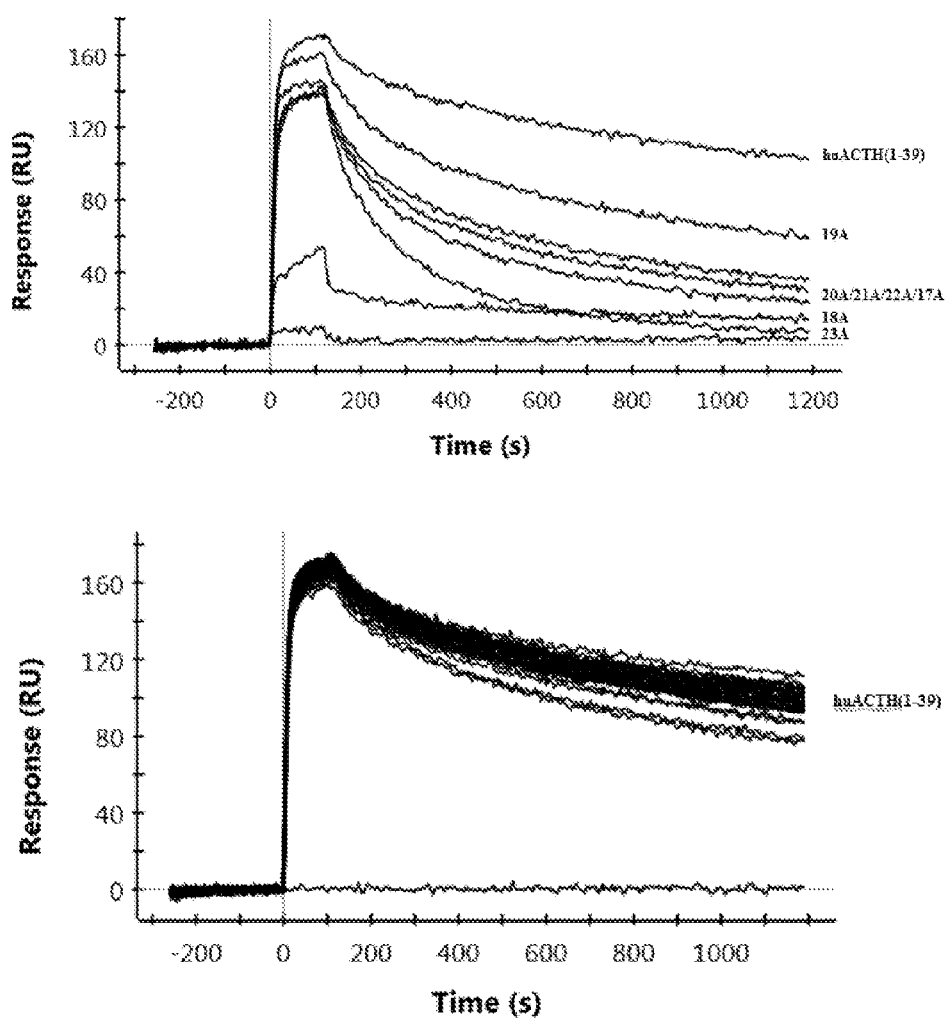
FIG. 40O. Binding kinetics of Ala mutants with Ab17

FIG. 41

| Ab1.H | Ab2.H | Ab3.H | Ab4.H | Ab5 | Ab6.H | Ab7.H | Ab9 | Ab10.H | Ab11.H | Ab11A.H | Ab12.H | Ab13.H | Ab15 | Ab17 |
|---|---|---|---|---|---|---|---|---|---|---|---|---|---|---|
| | | | | | | | | | | | | | | |
| | | | | | | | | | | | | | | |
| | | | | | | | | | | | | | | |
| | | | | | | | | | | | | | | |
| | | | | 7A | 7A | 7A | 7A | | | | | | | |
| | | | | 8A | 8A | 8A | 8A | | | | | | | |
| | | | | 9A | 9A | 9A | 9A | | | | | | | |
| | | | | 10A | 10A | 10A | 10A | | | | | | | |
| | | | | 11A | 11A | 11A | 11A | | | | | | | |
| | | | | | | | | | | | | | | |
| | | | | 13A | 13A | 13A | | | | | | | | |
| | | | | 14A | 14A | 14A | 14A | | | | | | | |
| 16A | 16A | 16A | 16A | | 16A | | | 16A | 16A | 16A | 16A | | | |
| | | | | | | | | | 17A | 17A | 17A | 17A | 17A | 17A |
| 18A | 18A | 18A | 18A | 18A | 18A | 18A | 18A | 18A | 18A | 18A | 18A | 18A | 18A | 18A |
| | | | | 19A | 19A | 19A | | | 19A | 19A | 19A | 19A | 19A | 19A |
| 20A | 20A | 20A | 20A | | | | | 20A | 20A | 20A | 20A | 20A | 20A | 20A |
| 21A | 21A | 21A | 21A | | | | | 21A | 21A | 21A | 21A | 21A | 21A | 21A |
| 22A | 22A | 22A | 22A | | | | | 22A | 22A | 22A | 22A | 22A | 22A | 22A |
| 23A | 23A | 23A | 23A | | 23A | | | 23A | 23A | 23A | 23A | 23A | 23A | 23A |

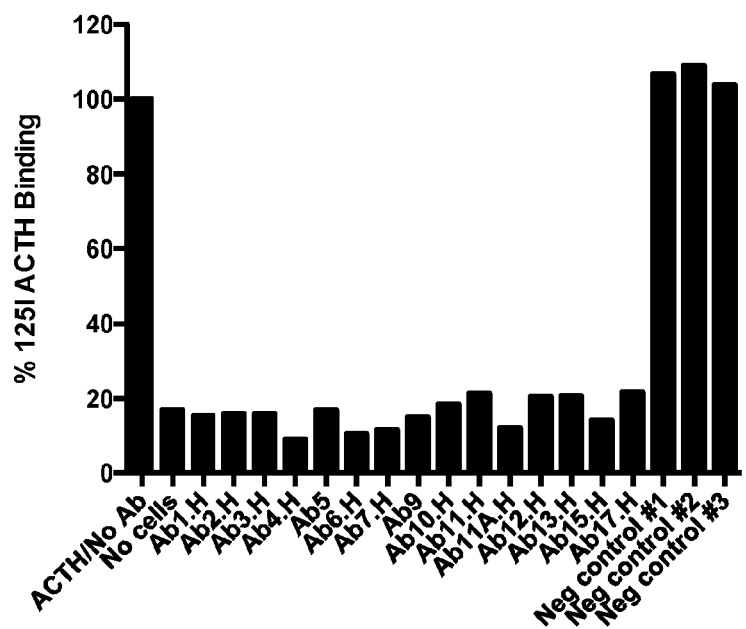
FIG. 42. Anti-ACTH antibodies inhibit binding of 125I ACTH to MC2R expressing cells

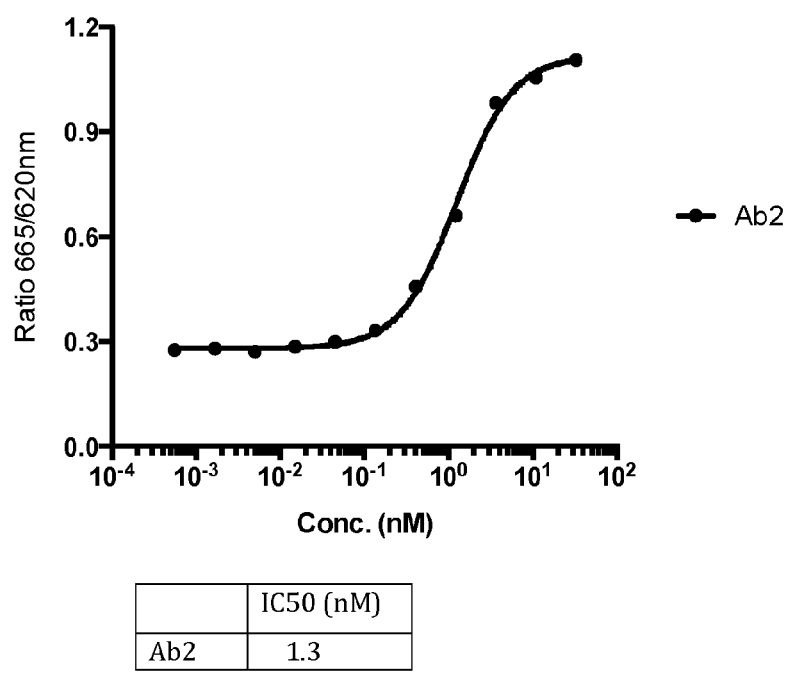
FIG. 43. Representative data showing neutralization of ACTH 1-24 induced signaling via MC2R by Ab2.

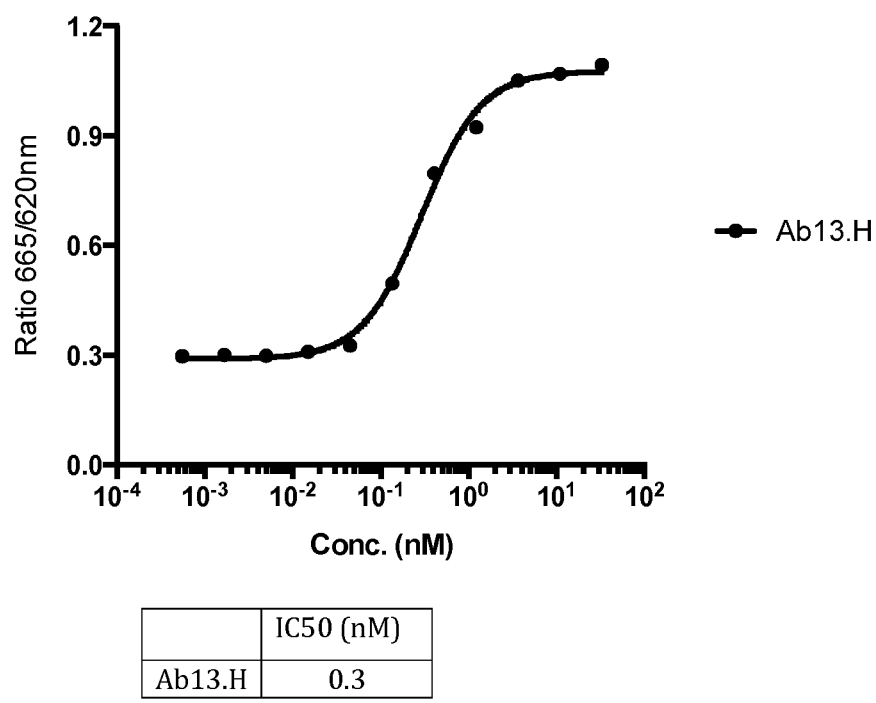
FIG. 44. Neutralization of ACTH 1-24 induced signaling via MC2R by Ab13.H.

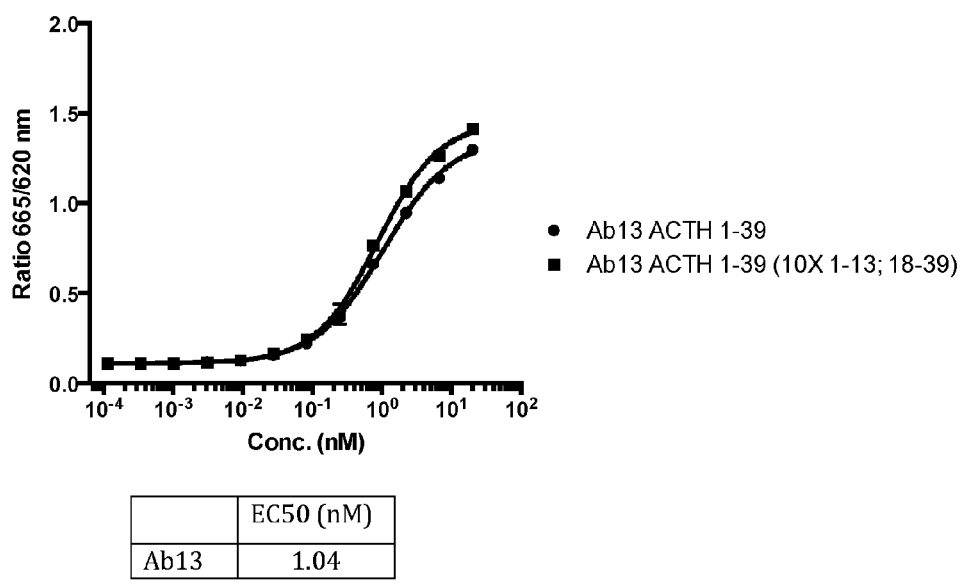
FIG. 45. Recognition of human ACTH 1-39 and lack of recognition of human ACTH 1-13 and 18-39.

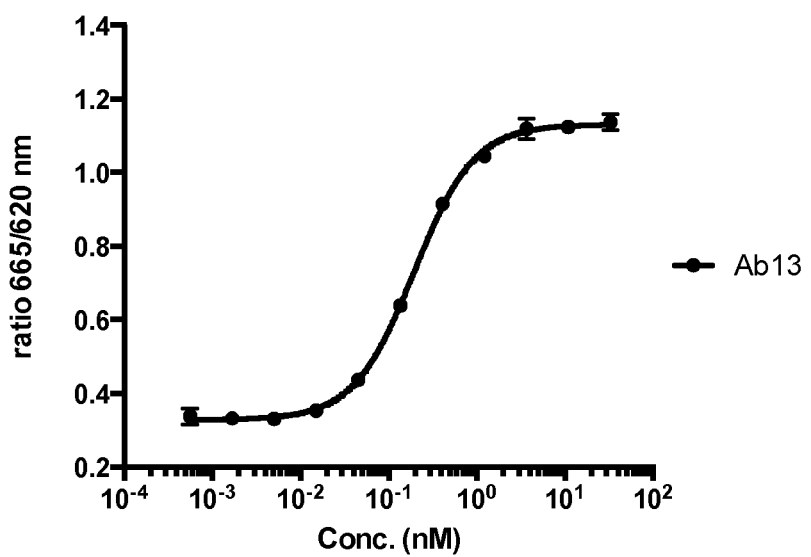
FIG. 46. Inhibition of ACTH driven cAMP production in MC2R expressing cells

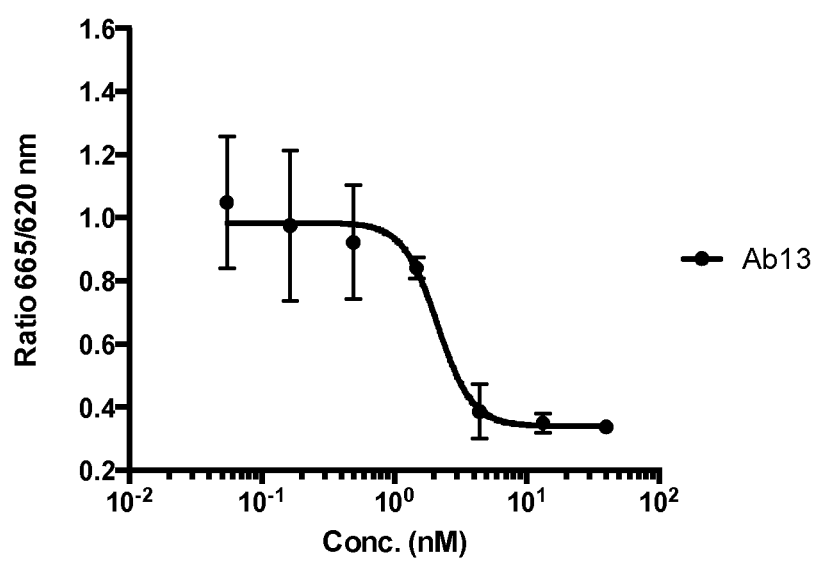
FIG. 47. Inhibition of ACTH driven cAMP production in MC1R expressing cells

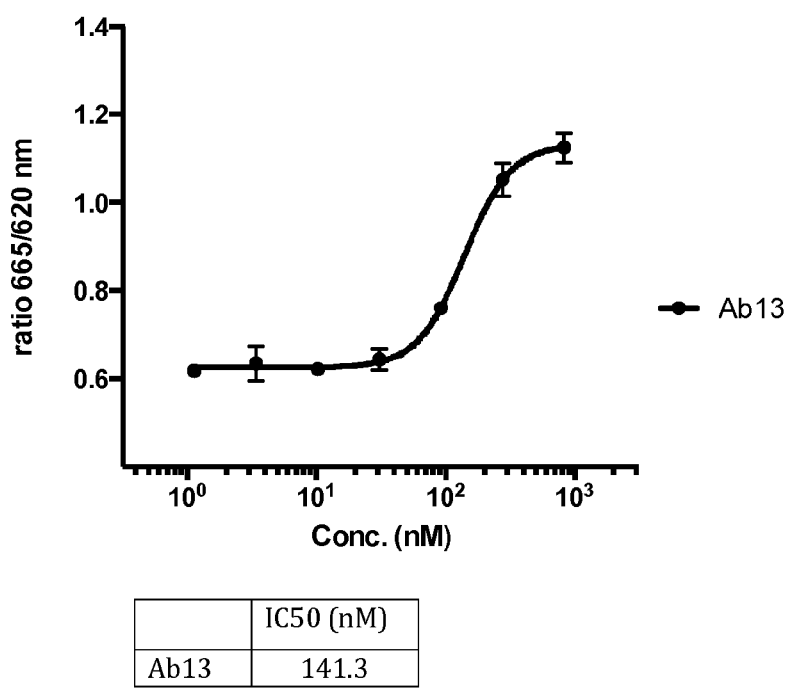
FIG. 48. Inhibition of ACTH driven cAMP production in MC3R expressing cells

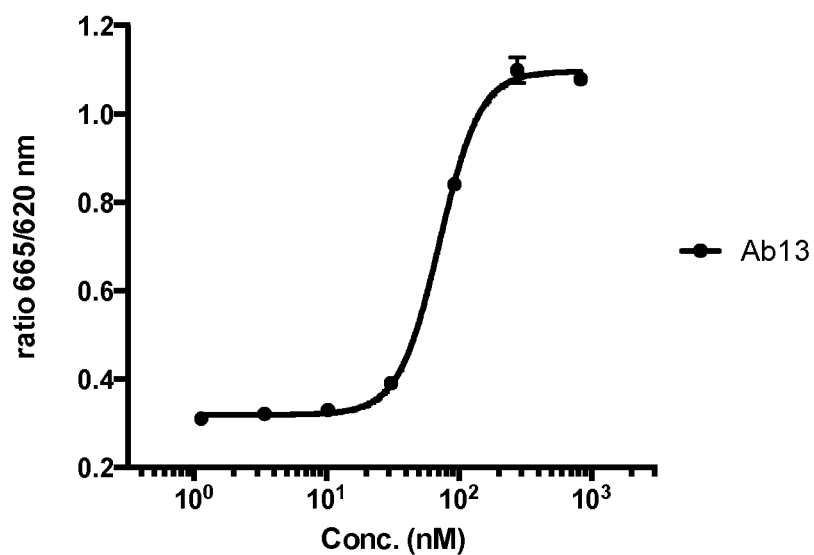
FIG. 49. Inhibition of ACTH driven cAMP production in MC4R expressing cells

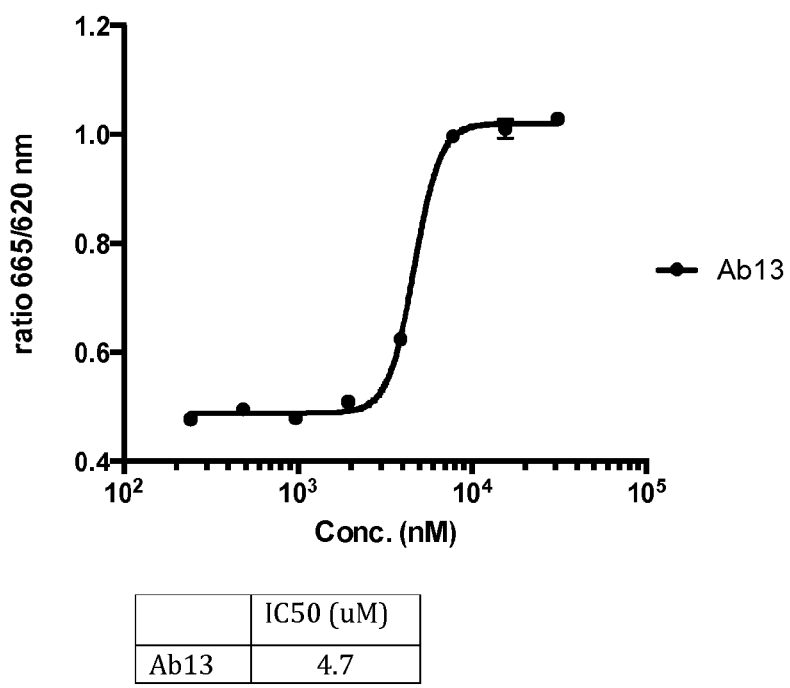
FIG. 50. Inhibition of ACTH driven cAMP production in MC5R expressing cells

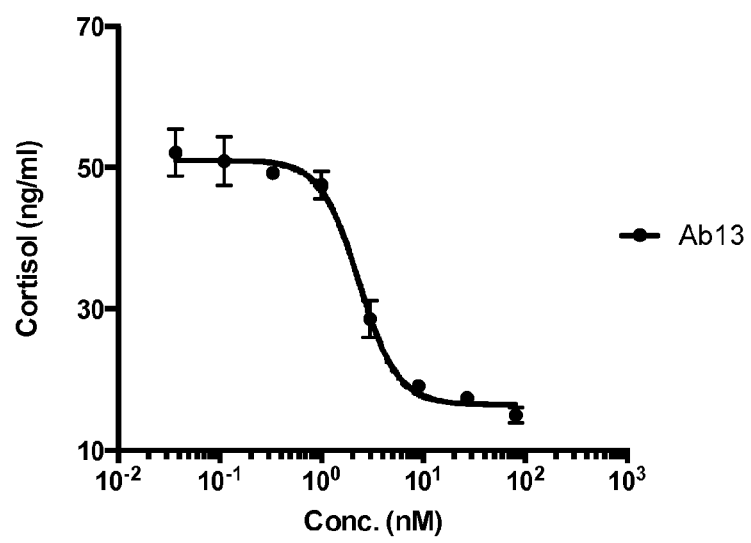
FIG. 51. Inhibition of ACTH driven cortisol production in Y1 cells

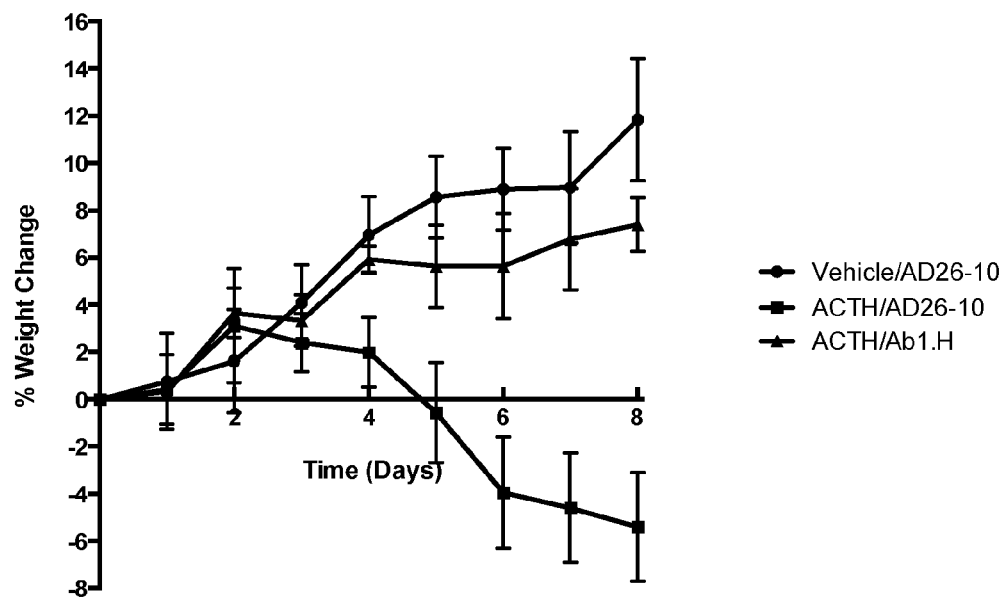
ANOVA Day 8: ACTH/Ab1.H to ACTH/AD26-10 = <0.0001
FIG. 52. Percent change in animal weight in rats receiving ACTH and Ab1.H or an isotype control.

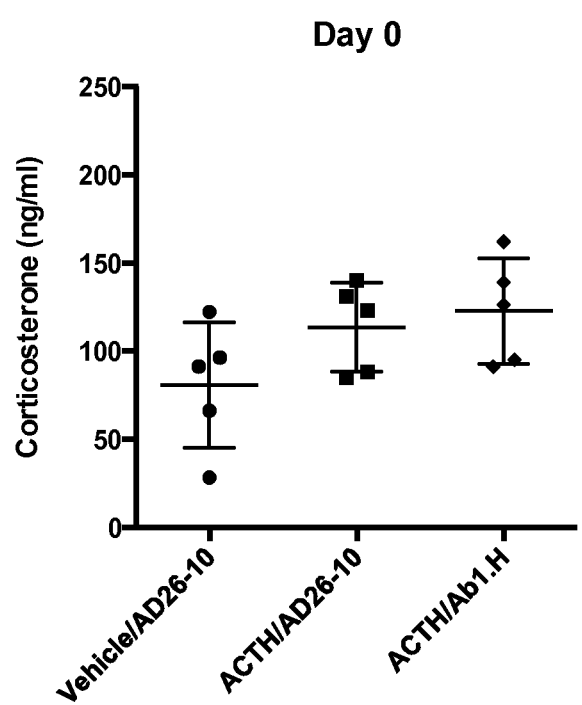
FIG. 53. Plasma corticosterone levels pre-ACTH and Ab dose

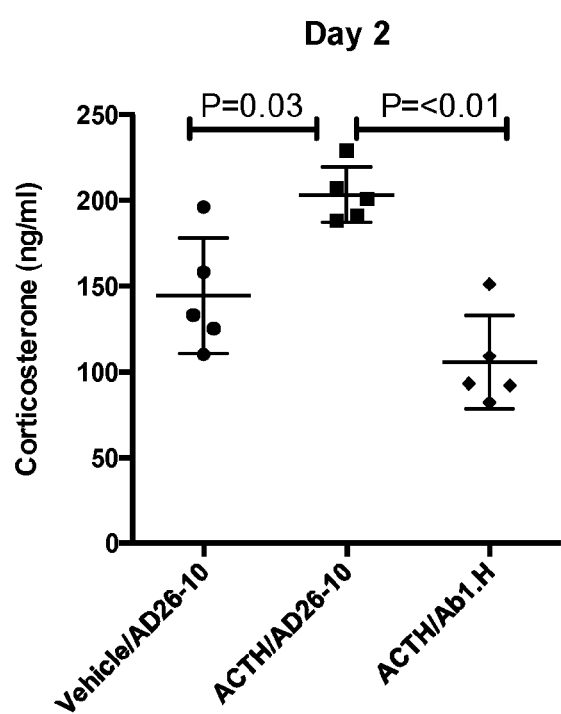
FIG. 54. Plasma corticosterone levels 24 hours post initiation of ACTH dosing and pre-Ab dose

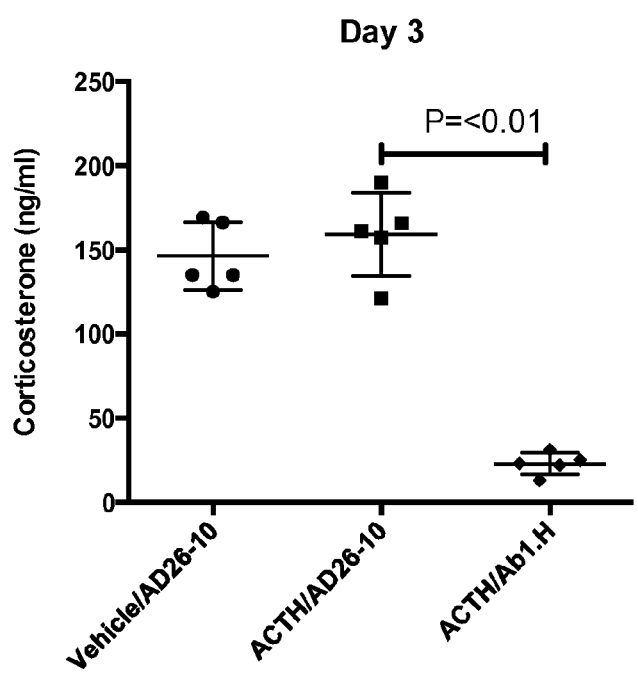
FIG. 55. Plasma corticosterone levels 48 hours post initiation of ACTH dosing and 24 hours post Ab dose

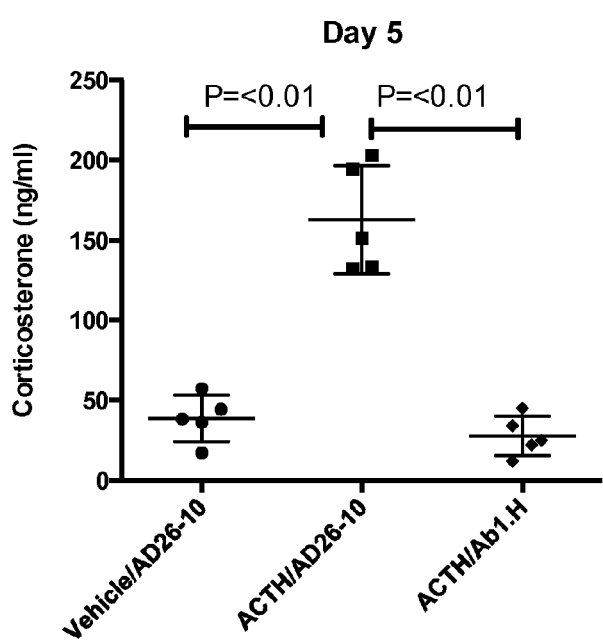
FIG. 56. Plasma corticosterone levels 96 hours post initiation of ACTH dosing and 72 hours post Ab dose

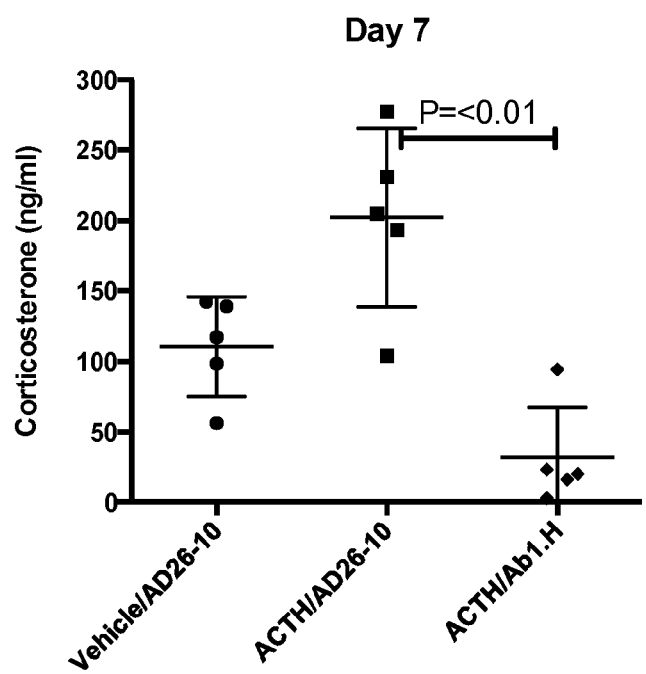
FIG. 57. Plasma corticosterone levels 144 hours post initiation of ACTH dosing and 120 hours post Ab dose

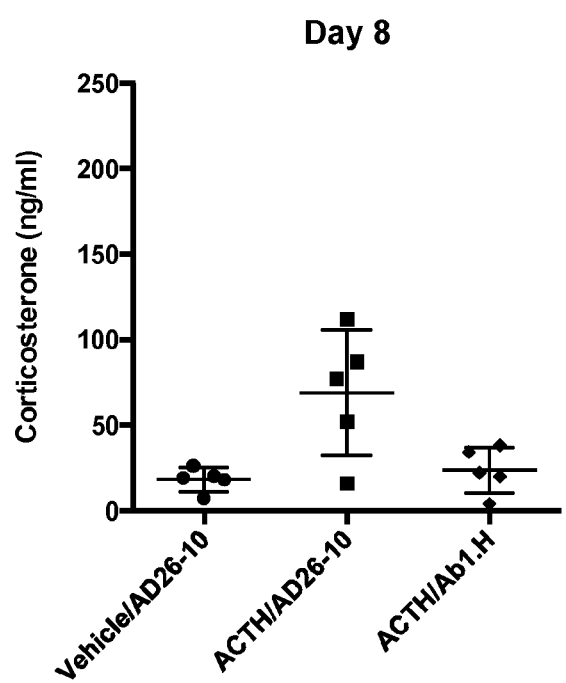
FIG. 58. Plasma corticosterone levels 168 hours post initiation of ACTH dosing and 144 hours post Ab dose

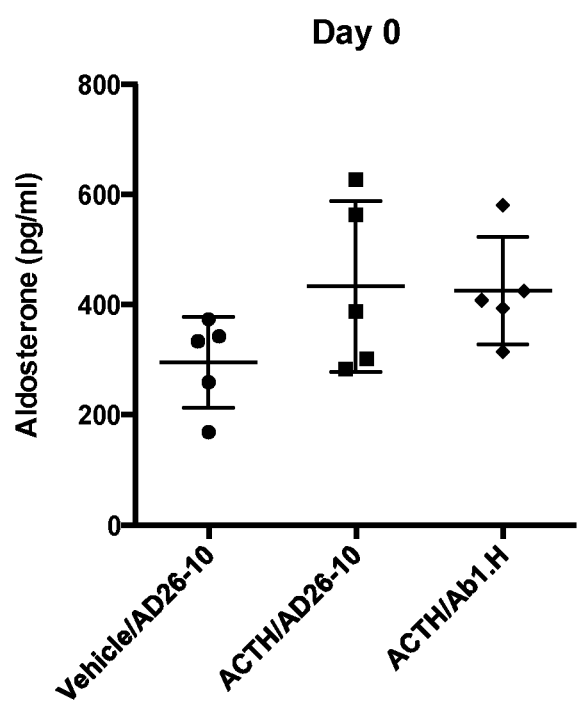
FIG. 59. Plasma aldosterone levels pre-ACTH and Ab dose

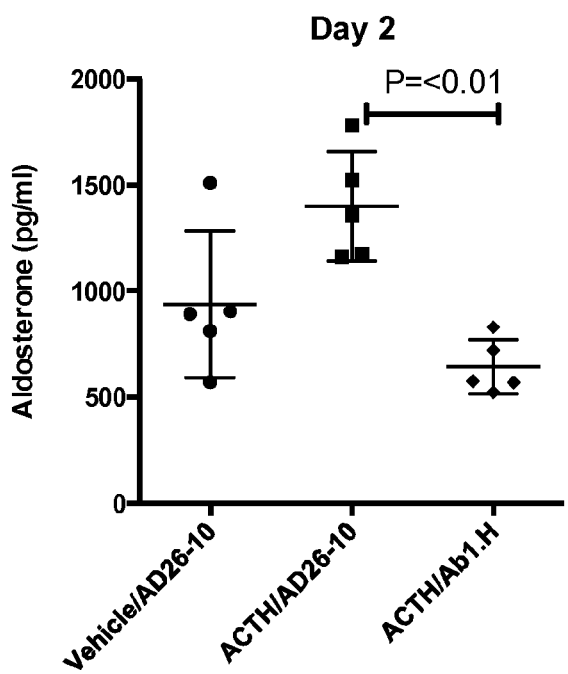
FIG. 60. Plasma aldosterone levels 24 hours post initiation of ACTH dosing and pre-Ab dose

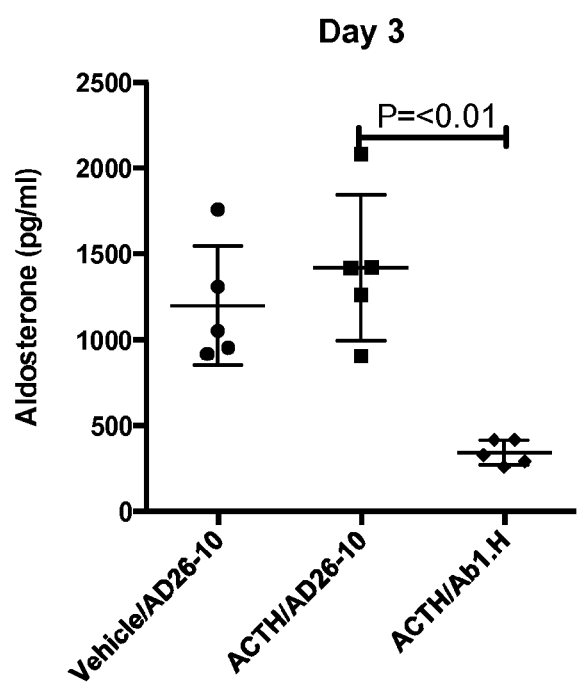
FIG. 61. Plasma aldosterone levels 48 hours post initiation of ACTH dosing and 24 hours post Ab dose

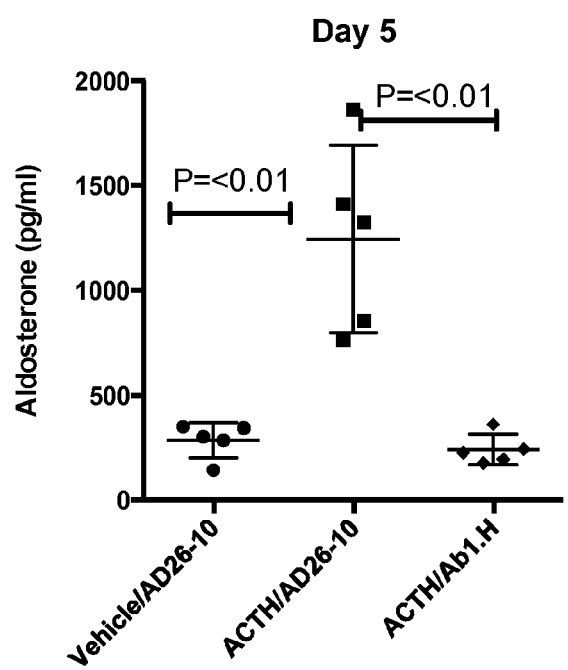
FIG. 62. Plasma aldosterone levels 96 hours post initiation of ACTH dosing and 72 hours post Ab dose

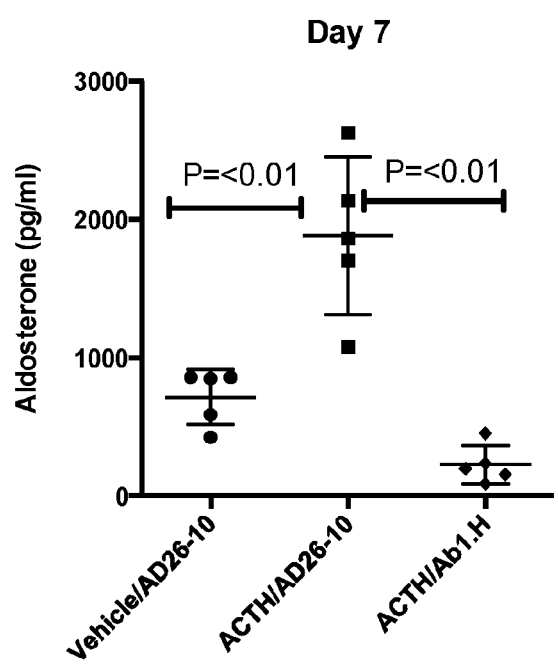
FIG. 63. Plasma aldosterone levels 144 hours post initiation of ACTH dosing and 120 hours post Ab dose

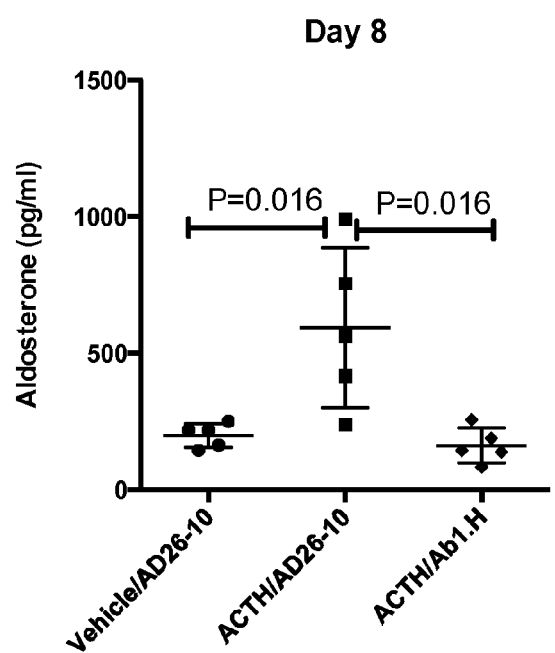
FIG. 64. Plasma aldosterone levels 168 hours post initiation of ACTH dosing and 144 hours post Ab dose

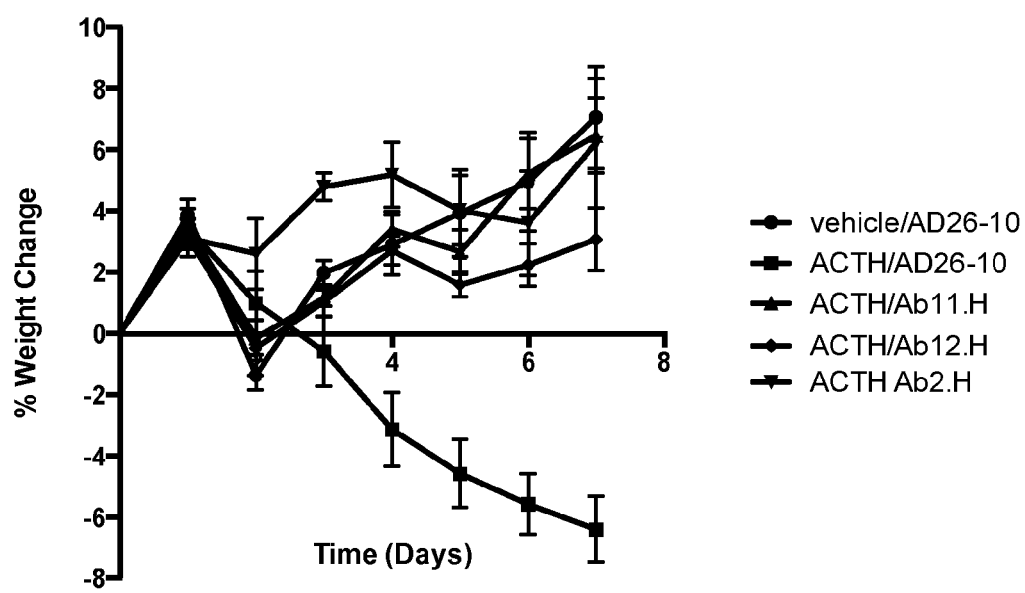
ANOVA Day 7: ACTH/Ab2.H to ACTH/AD26-10 = <0.0001
ANOVA Day 7: ACTH/Ab11.H to ACTH/AD26-10 = <0.0001
ANOVA Day 7: ACTH/Ab12.H to ACTH/AD26-10 = <0.0001
FIG. 65. Ab2.H, Ab11.H, and Ab12.H inhibited ACTH-induced weight loss.

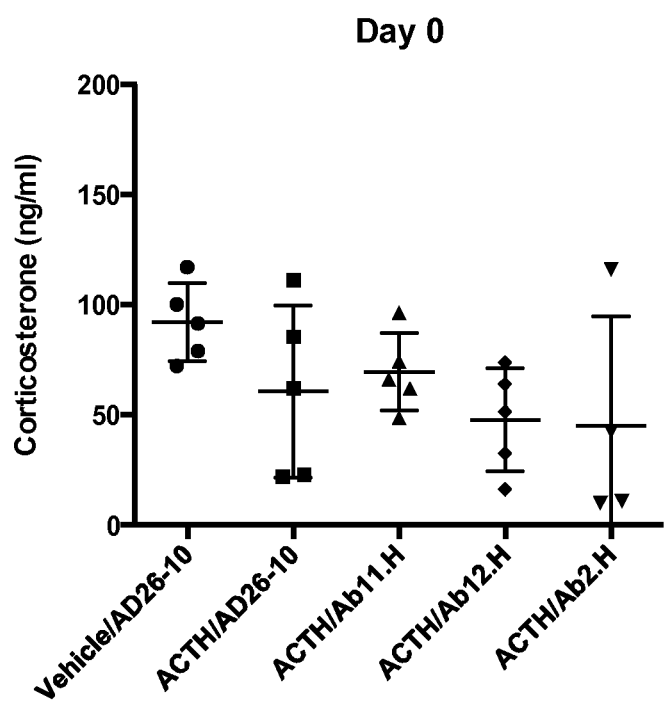
FIG. 66. Plasma corticosterone levels pre-ACTH and Ab dose

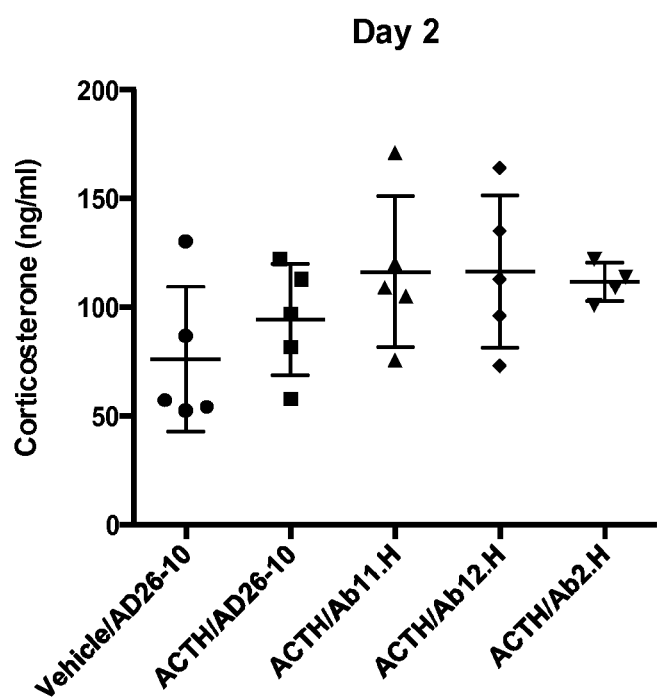
FIG. 67. Plasma corticosterone levels 24 hours post initiation of ACTH dosing and pre-Ab dose

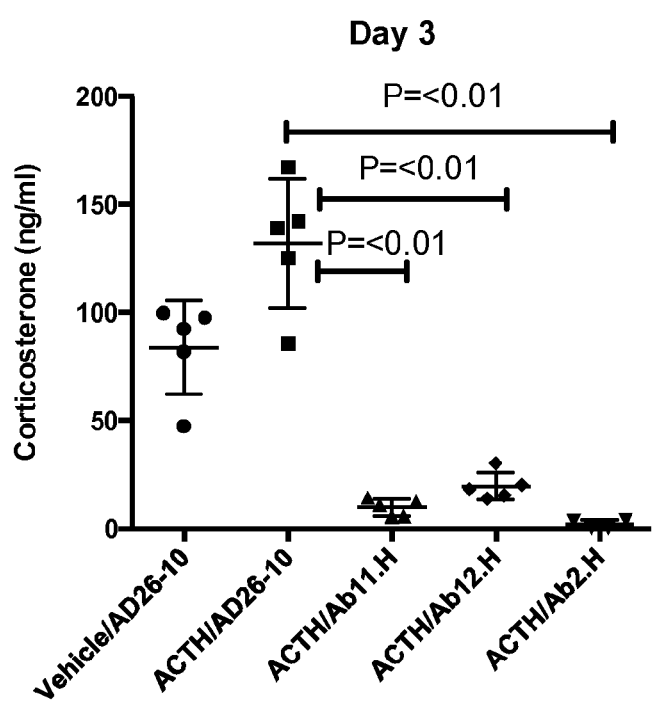
FIG. 68. Plasma corticosterone levels 48 hours post initiation of ACTH dosing and 24 hours post Ab dose

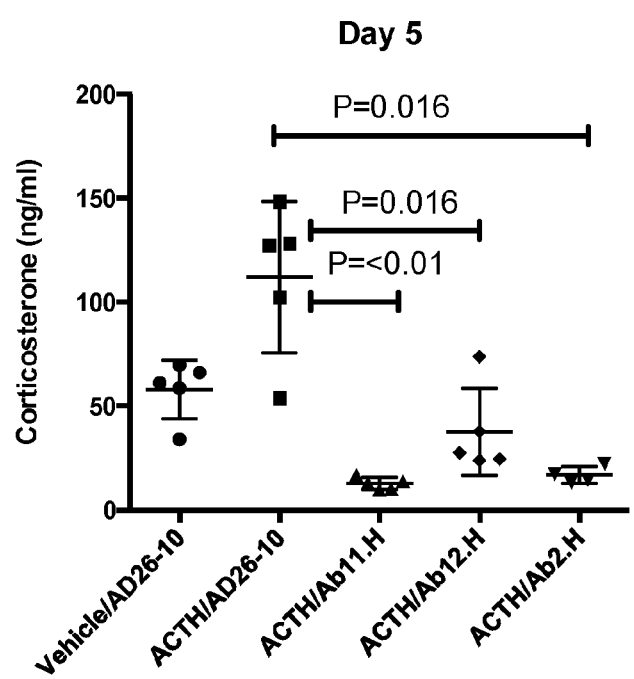
FIG. 69. Plasma corticosterone levels 96 hours post initiation of ACTH dosing and 72 hours post Ab dose

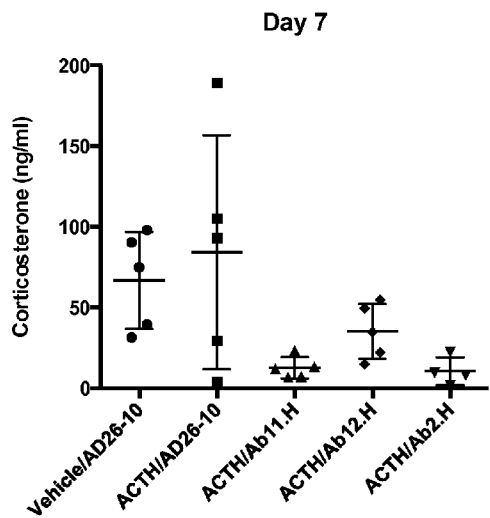
FIG. 70. Plasma corticosterone levels 144 hours post initiation of ACTH dosing and 120 hours post Ab dose

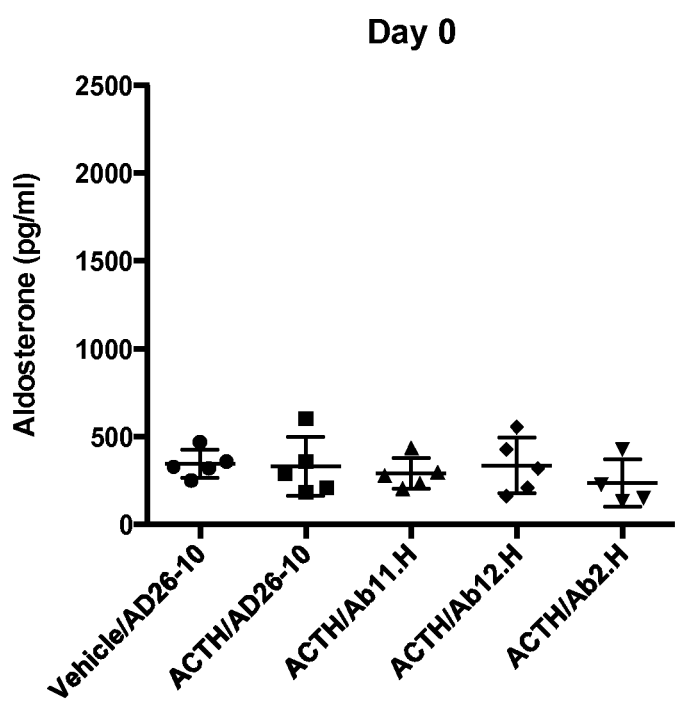
FIG. 71. Plasma aldosterone levels pre-ACTH and Ab dose

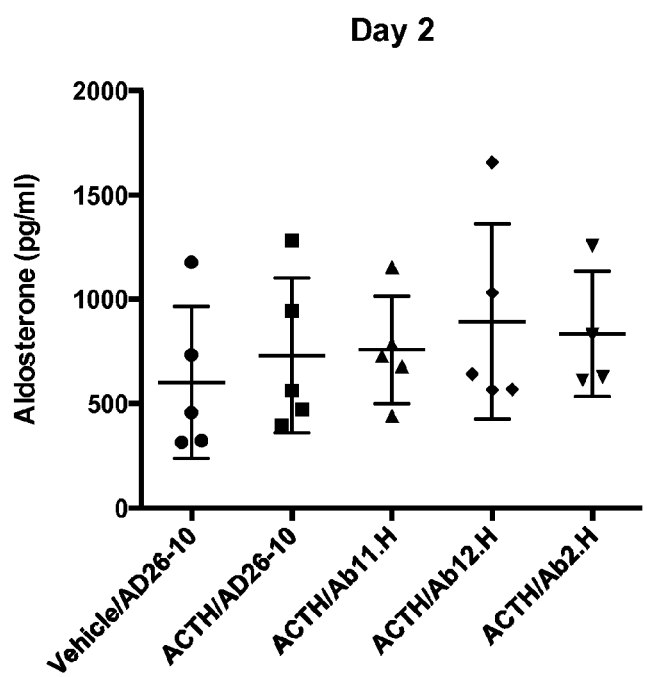
FIG. 72. Plasma aldosterone levels 24 hours post initiation of ACTH dosing and pre-Ab dose

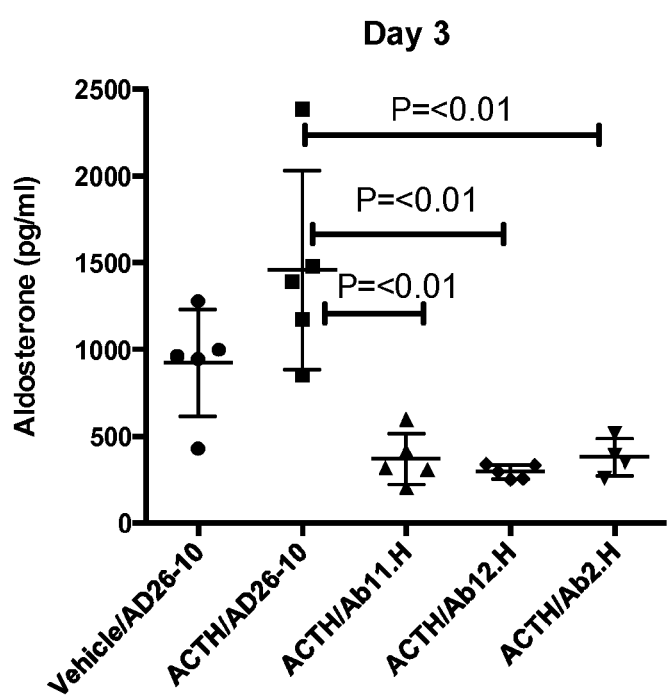
FIG. 73. Plasma aldosterone levels 48 hours post initiation of ACTH dosing and 24 hours post Ab dose

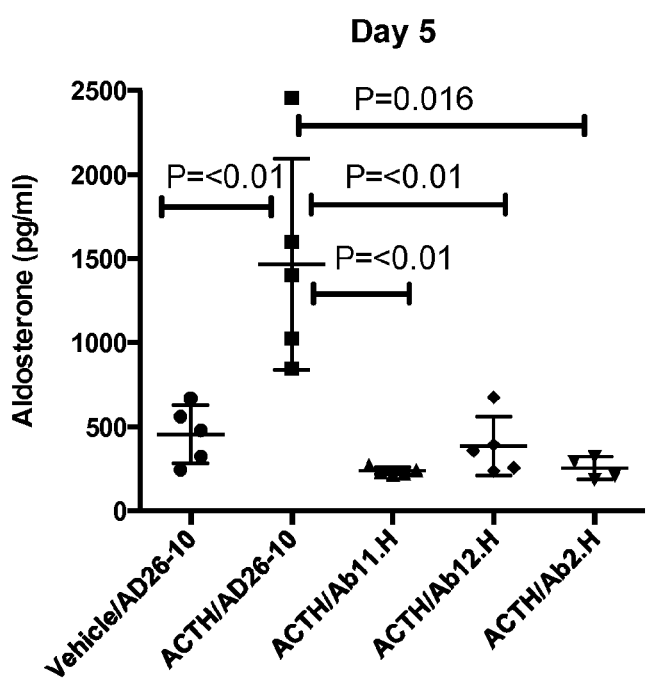
FIG. 74. Plasma aldosterone levels 96 hours post initiation of ACTH dosing and 72 hours post Ab dose

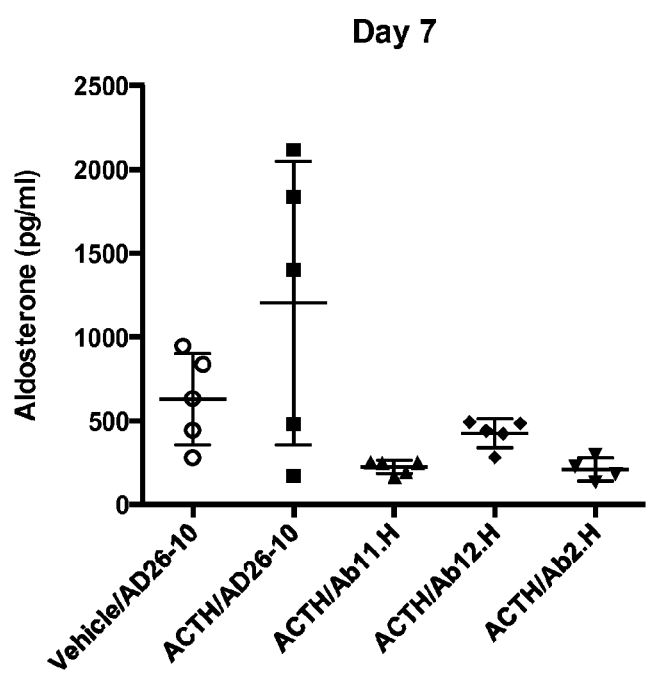
FIG. 75. Plasma aldosterone levels 144 hours post initiation of ACTH dosing and 120 hours post Ab dose

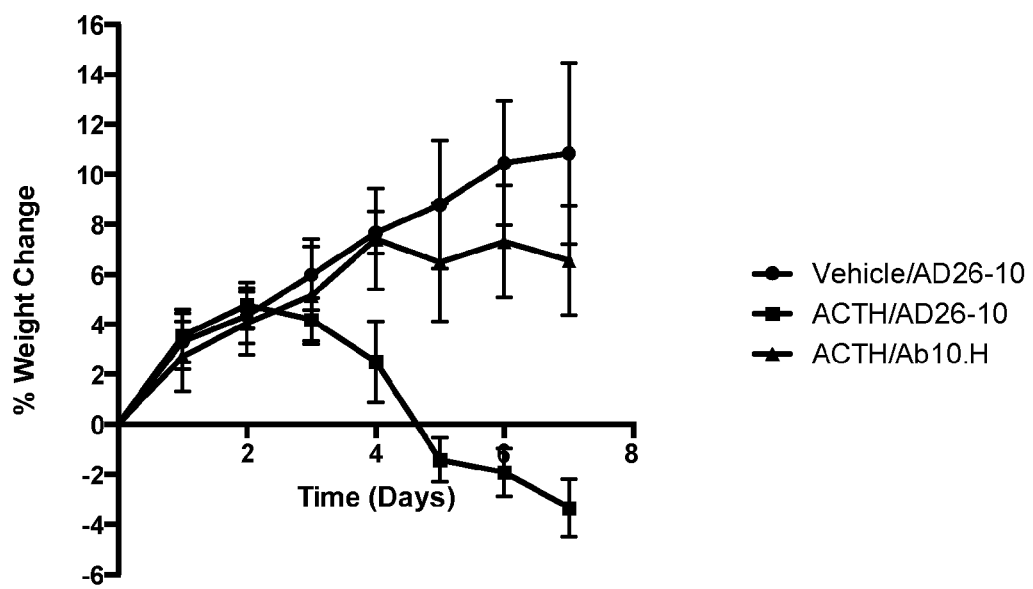
ANOVA Day 7: ACTH/Ab10.H to ACTH/AD26-10 = <0.0001
FIG. 76. Ab10.H inhibited ACTH-induced weight loss.

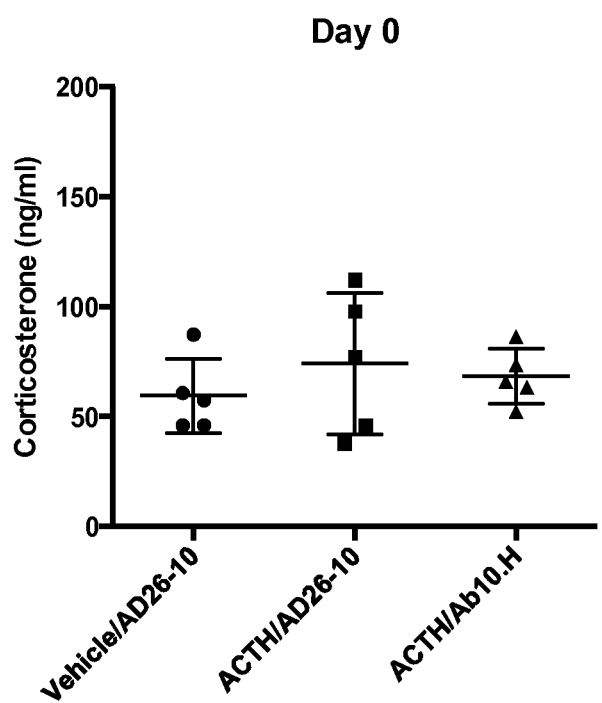
FIG. 77. Plasma corticosterone levels pre-ACTH and Ab dose

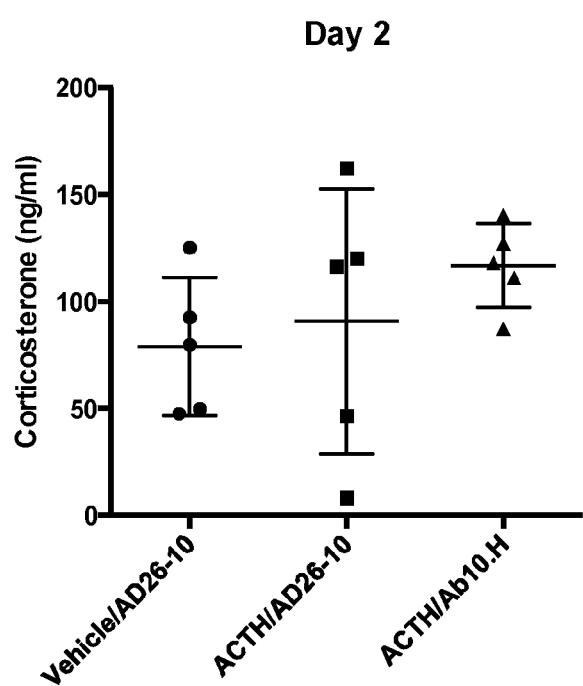
FIG. 78. Plasma corticosterone levels 24 hours post initiation of ACTH dosing and pre-Ab dose

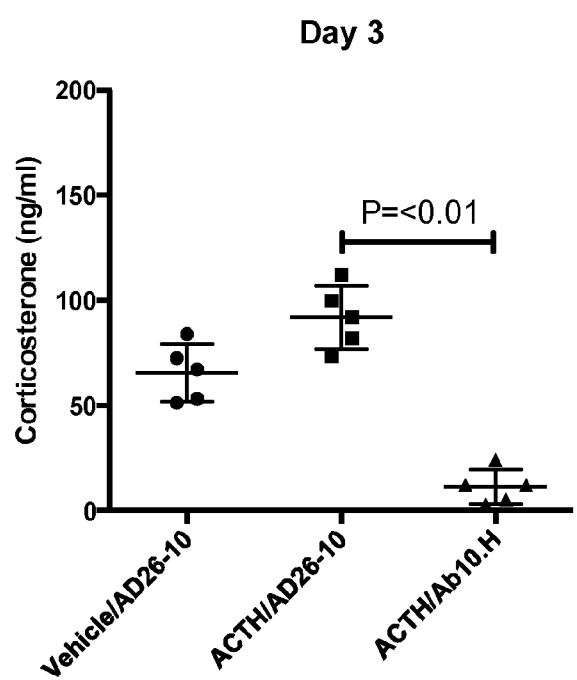
FIG. 79. Plasma corticosterone levels 48 hours post initiation of ACTH dosing and 24 hours post Ab dose

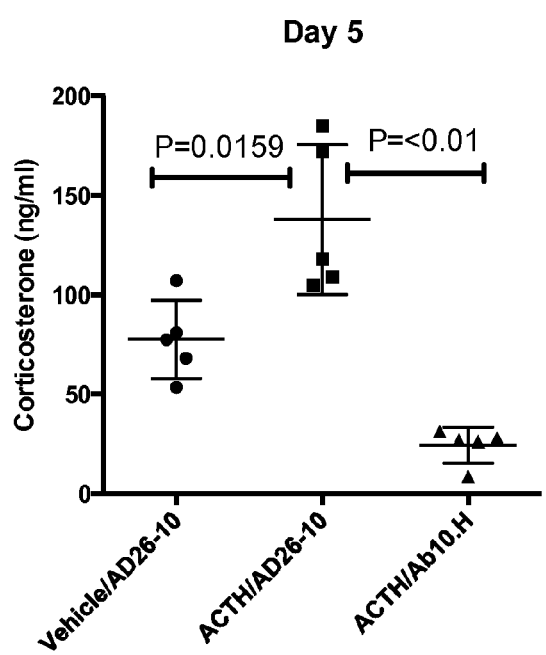
FIG. 80. Plasma corticosterone levels 96 hours post initiation of ACTH dosing and 72 hours post Ab dose

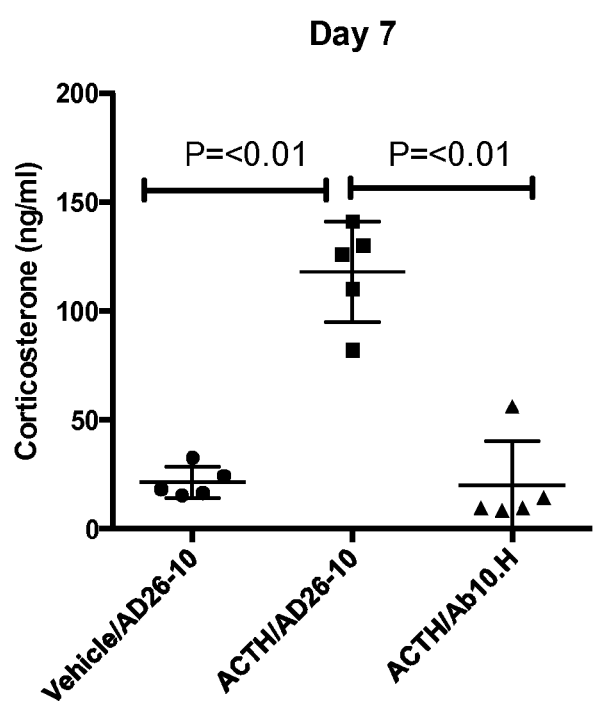
FIG. 81. Plasma corticosterone 144 hours post initiation of ACTH dosing and 120 hours post Ab dose

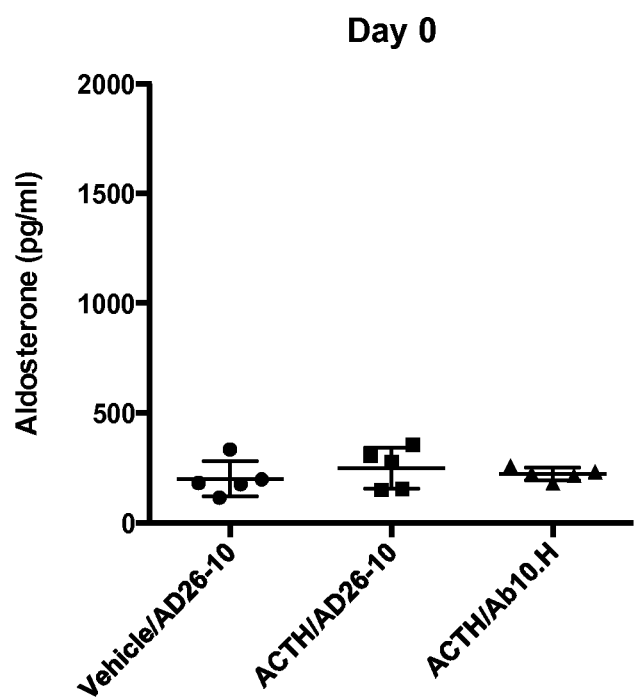
FIG. 82. Plasma aldosterone levels pre-ACTH and Ab dose

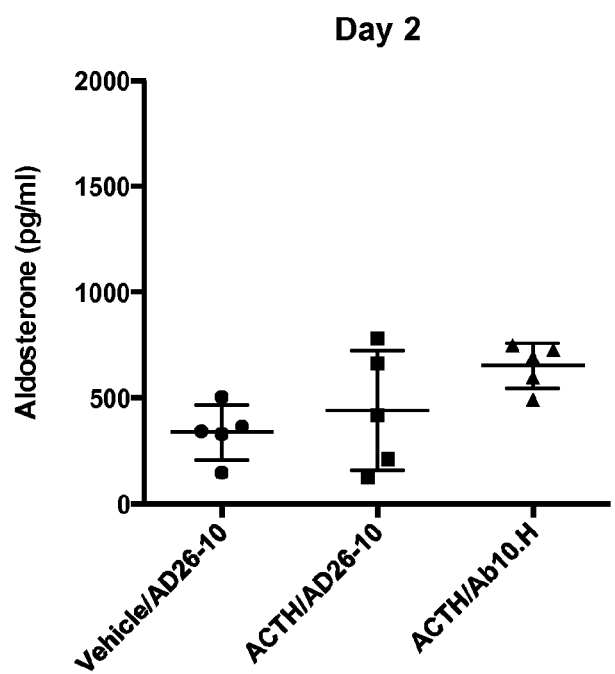
FIG. 83. Plasma aldosterone levels 24 hours post initiation of ACTH dosing and pre-Ab dose

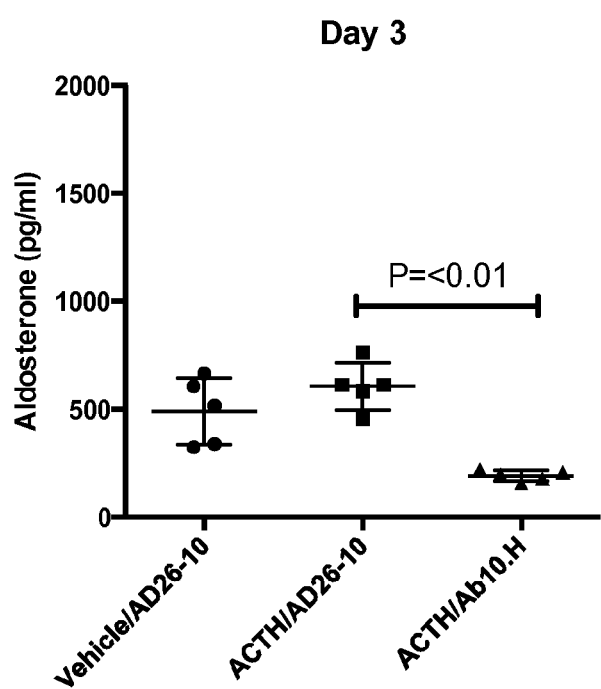
FIG. 84. Plasma aldosterone levels 48 hours post initiation of ACTH dosing and 24 hours post Ab dose

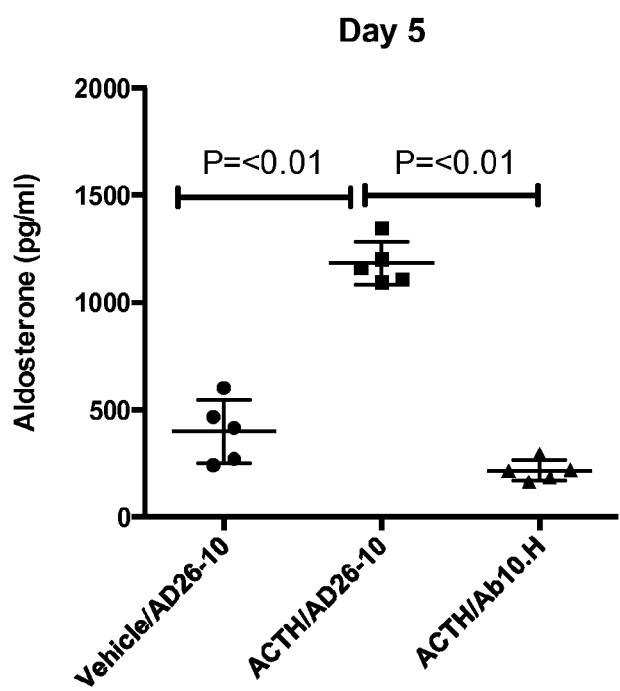
FIG. 85. Plasma aldosterone levels 96 hours post initiation of ACTH dosing and 72 hours post Ab dose

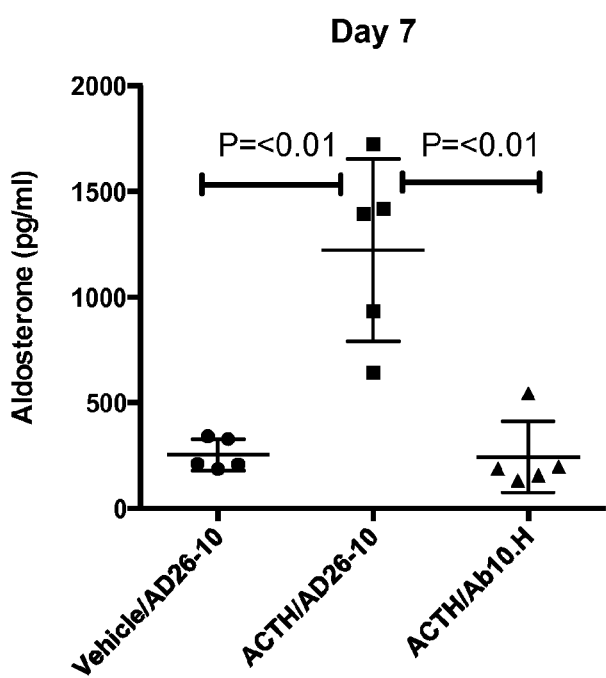
FIG. 86. Plasma aldosterone levels 144 hours post initiation of ACTH dosing and 120 hours post Ab dose

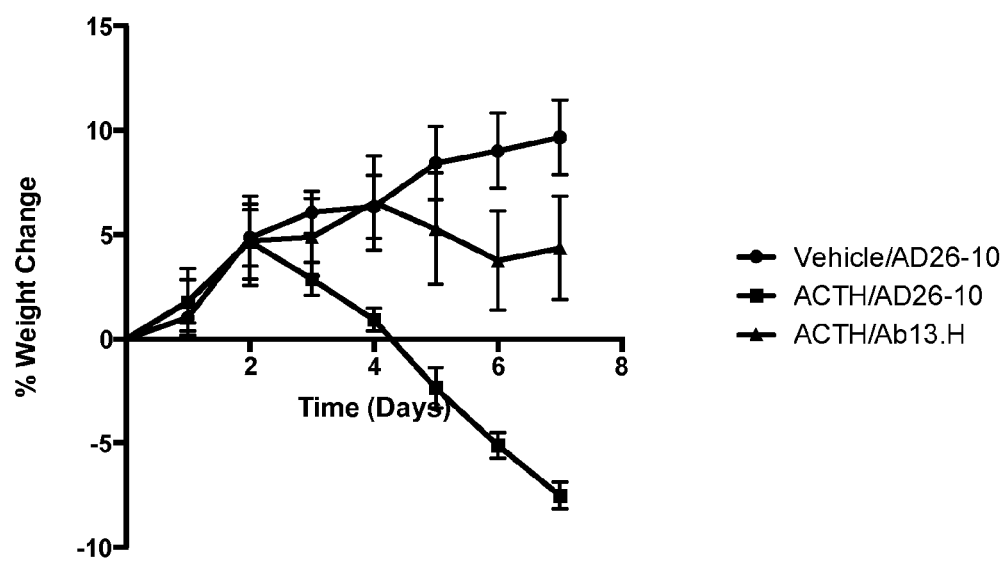
ANOVA Day 7: ACTH/Ab13.H to ACTH/AD26-10 = <0.0001
FIG. 87. Ab13.H inhibited ACTH-induced weight loss.

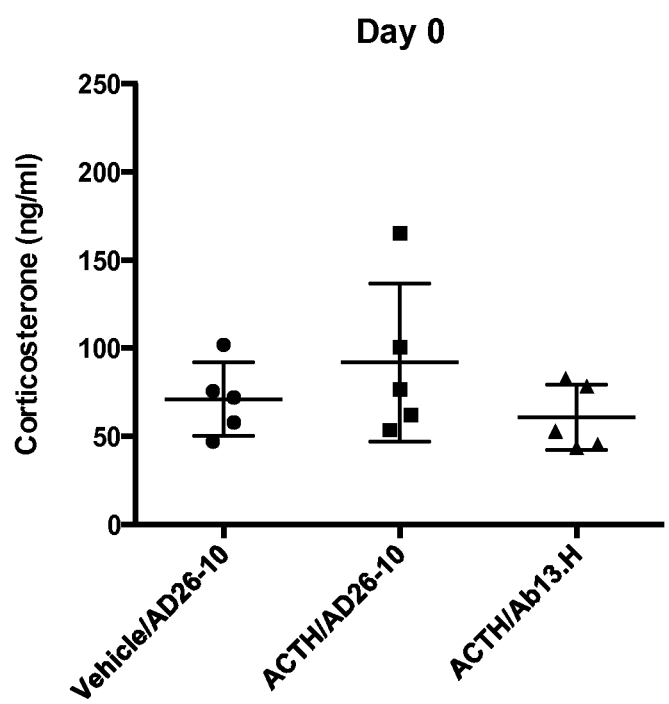
FIG. 88. Plasma corticosterone levels pre-ACTH and Ab dose

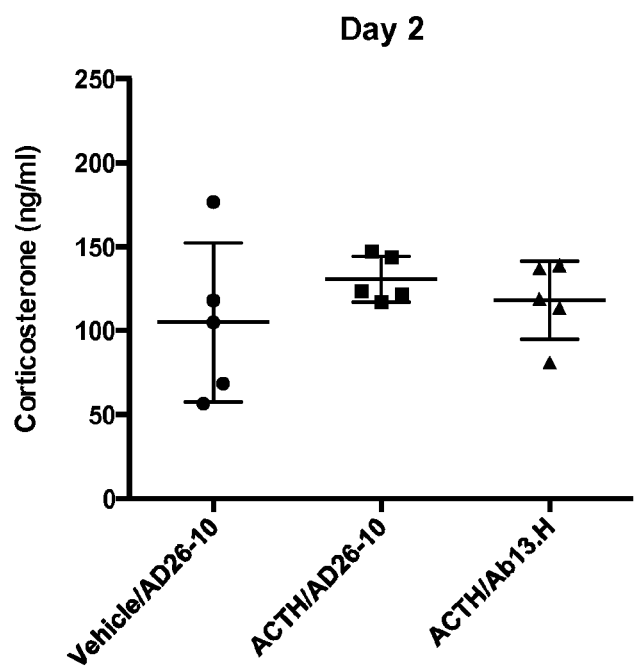
FIG. 89. Plasma corticosterone levels 24 hours post initiation of ACTH dosing and pre-Ab dose

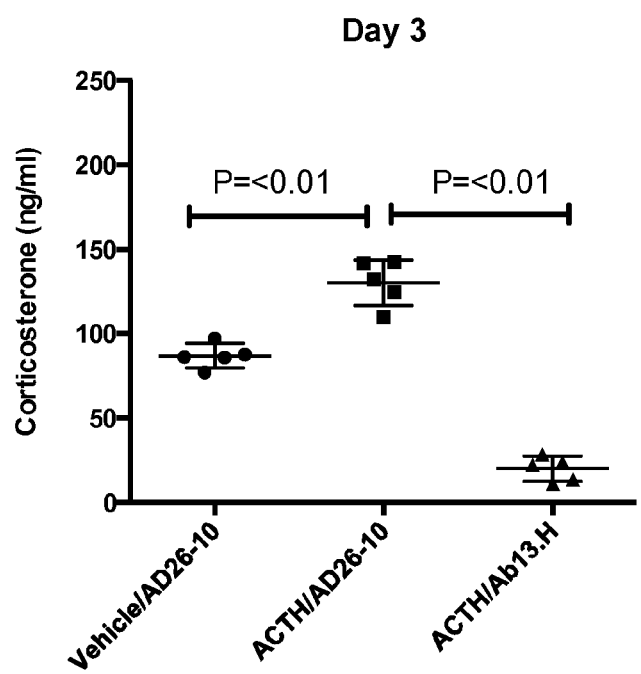
FIG. 90. Plasma corticosterone levels 48 hours post initiation of ACTH dosing and 24 hours post Ab dose

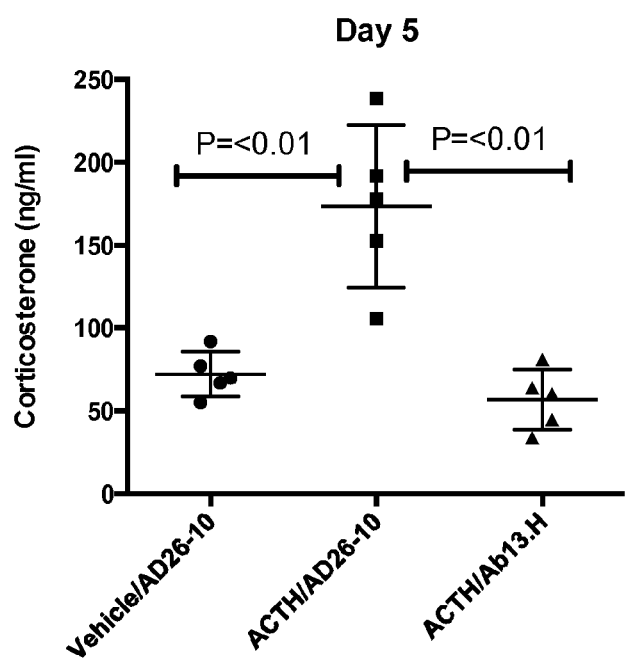
FIG. 91. Plasma corticosterone levels 96 hours post initiation of ACTH dosing and 72 hours post Ab dose

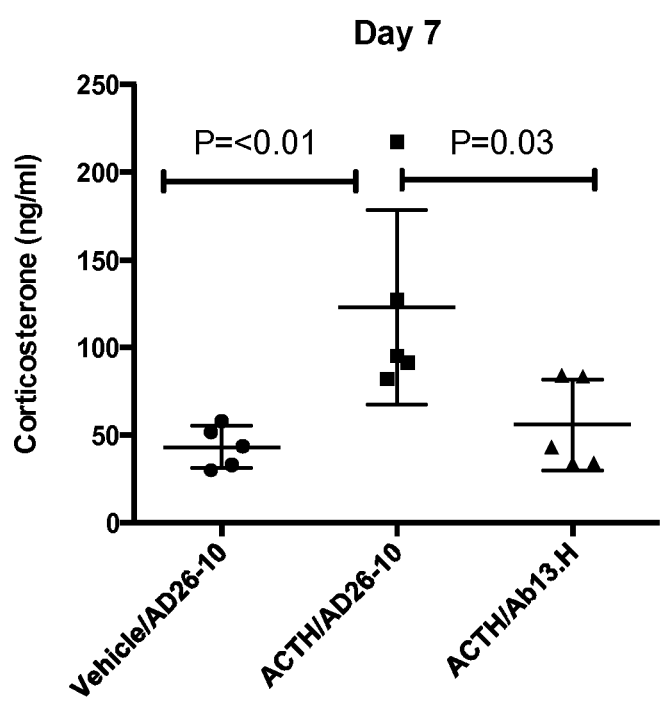
FIG. 92. Plasma corticosterone 144 hours post initiation of ACTH dosing and 120 hours post Ab dose

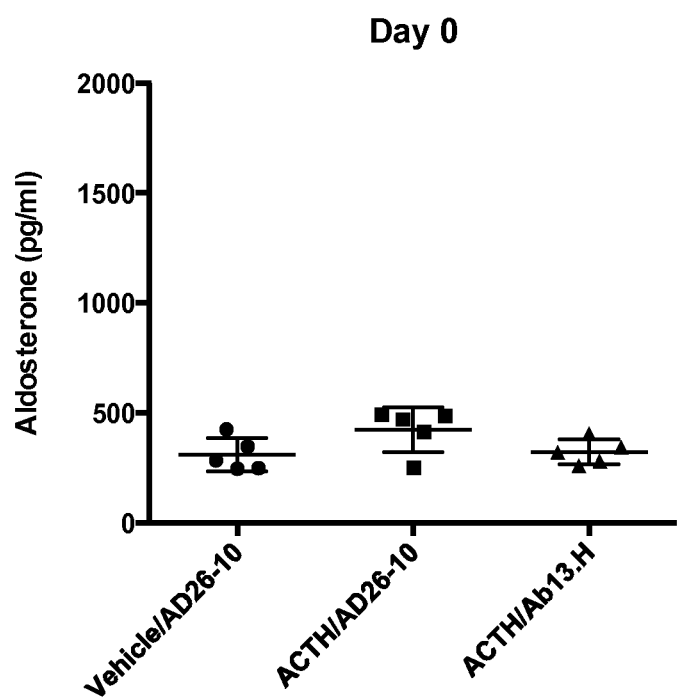
FIG. 93. Plasma aldosterone levels pre-ACTH and Ab dose

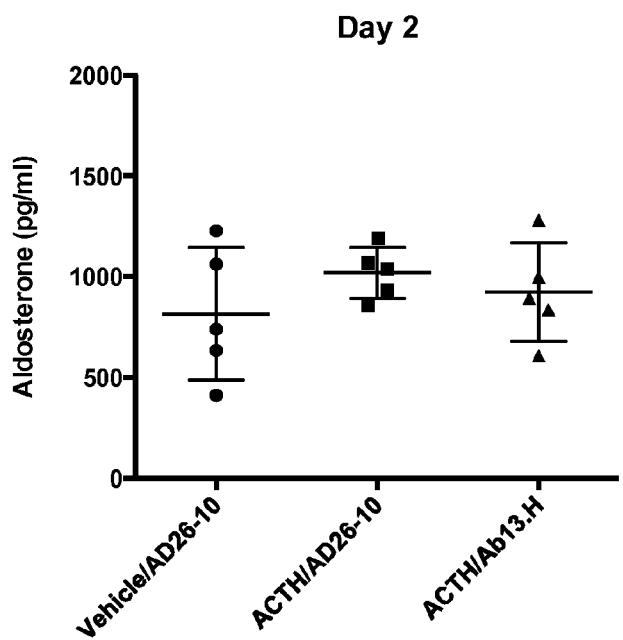
FIG. 94. Plasma aldosterone levels 24 hours post initiation of ACTH dosing and pre-Ab dose

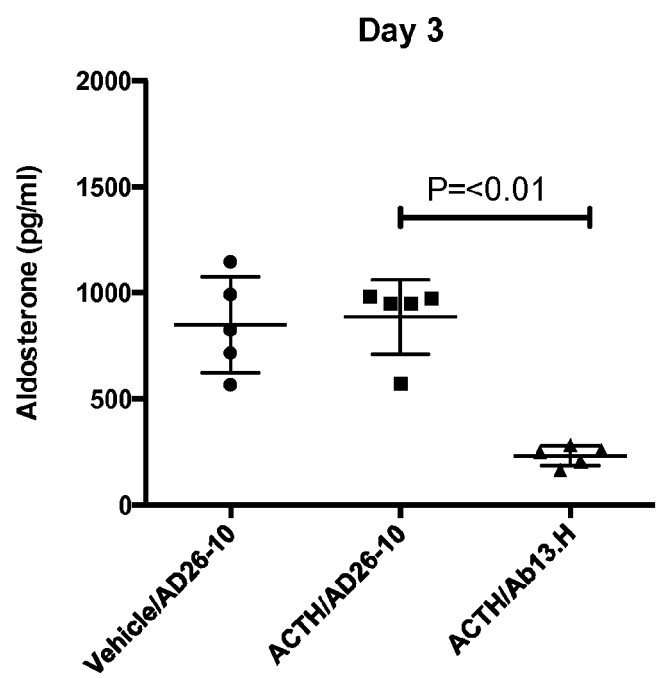
FIG. 95. Plasma aldosterone levels 48 hours post initiation of ACTH dosing and 24 hours post Ab dose

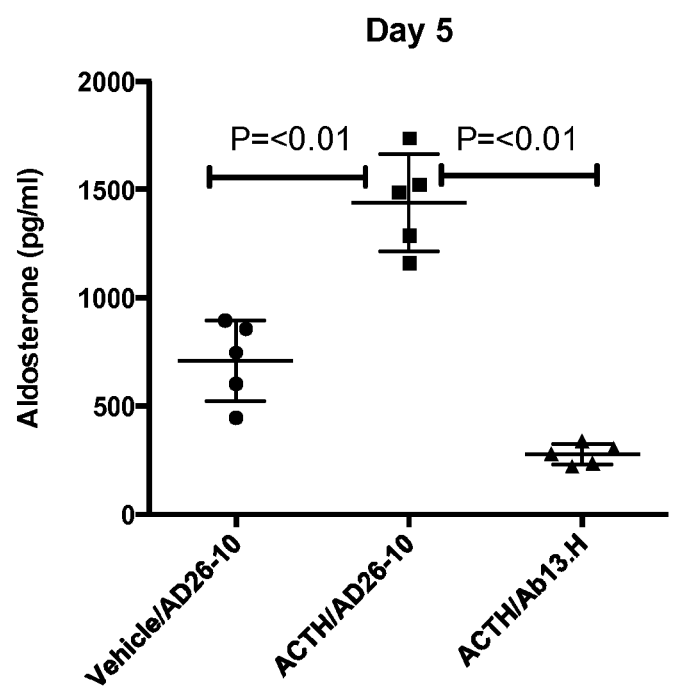
FIG. 96. Plasma aldosterone levels 96 hours post initiation of ACTH dosing and 72 hours post Ab dose

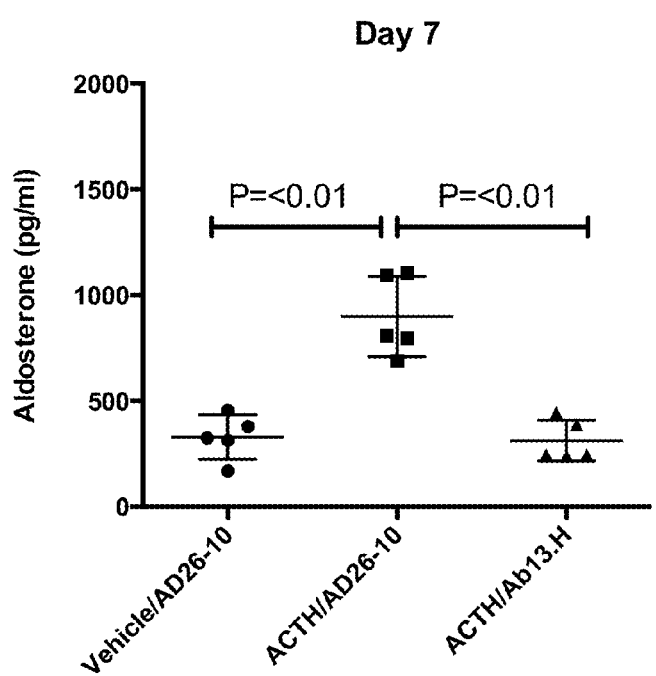
FIG. 97. Plasma aldosterone levels 144 hours post initiation of ACTH dosing and 120 hours post Ab dose

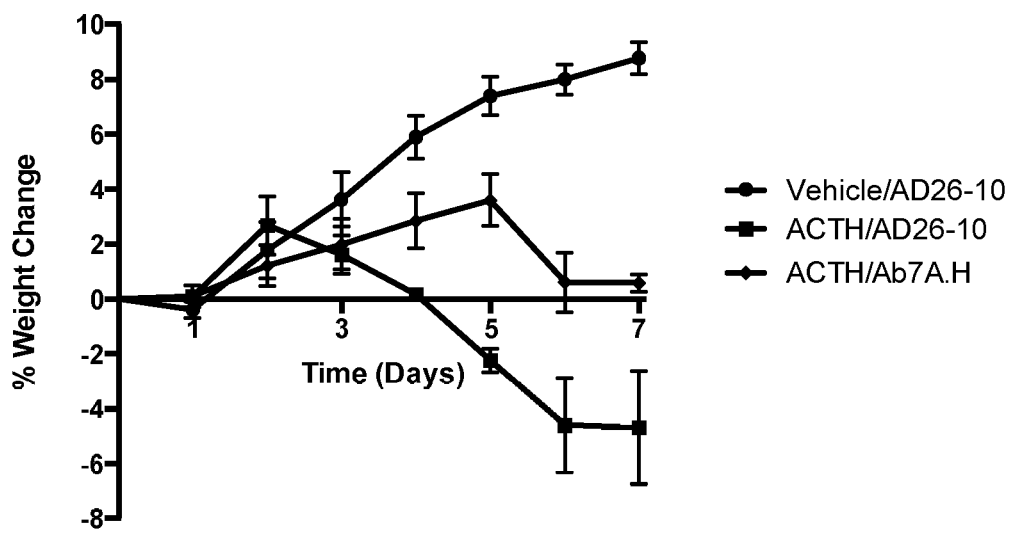
ANOVA Day 7: ACTH/Ab7A.H to ACTH/AD26-10 = <0.0001
FIG. 98. Ab7.A.H inhibited ACTH-induced weight loss.

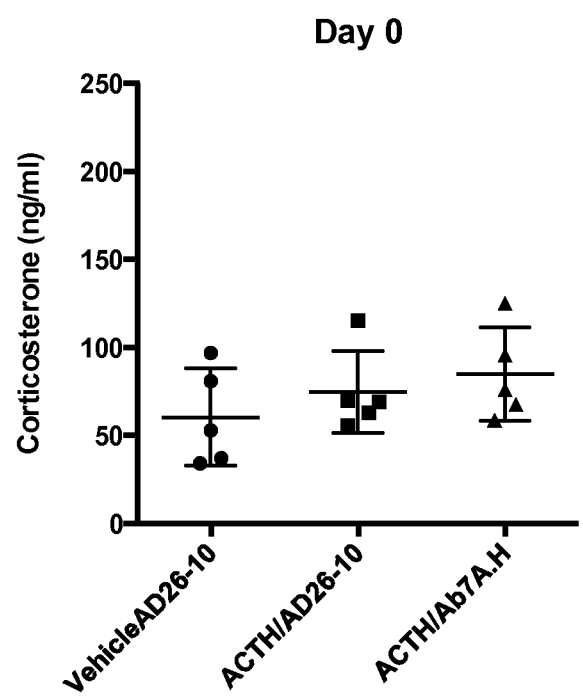
FIG. 99. Plasma corticosterone levels pre-ACTH and Ab dose

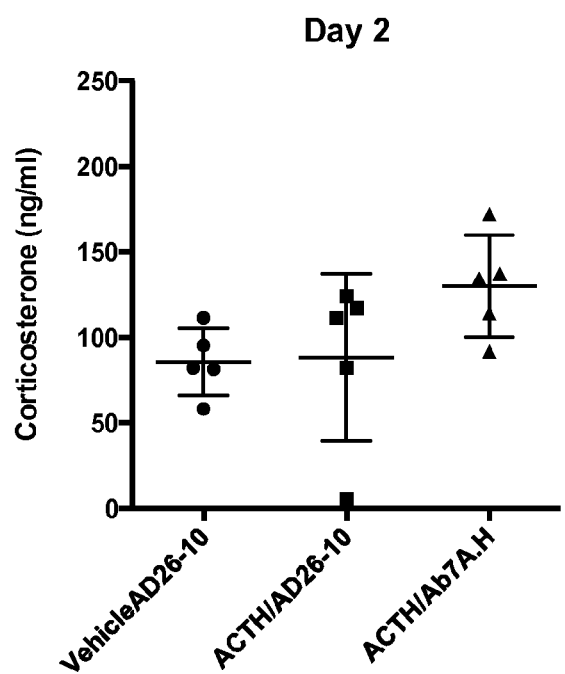
FIG. 100. Plasma corticosterone levels 24 hours post initiation of ACTH dosing and pre-Ab dose

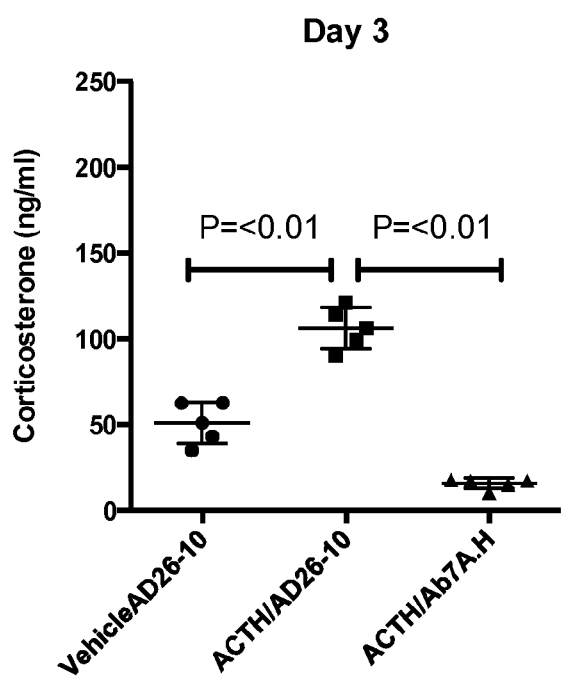
FIG. 101. Plasma corticosterone levels 48 hours post initiation of ACTH dosing and 24 hours post Ab dose

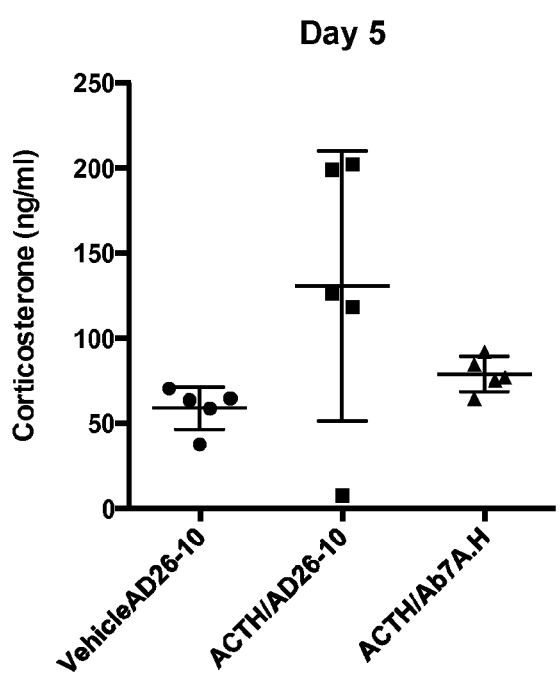
FIG. 102. Plasma corticosterone levels 96 hours post initiation of ACTH dosing and 72 hours post Ab dose

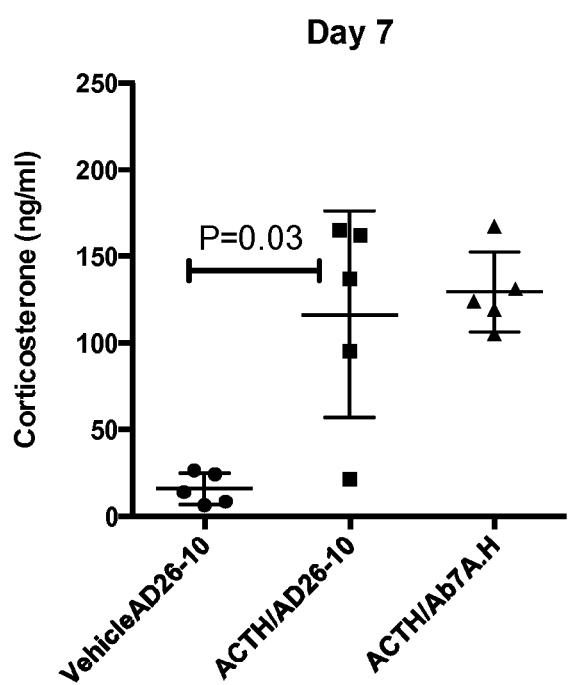
FIG. 103. Plasma corticosterone 144 hours post initiation of ACTH dosing and 120 hours post Ab dose

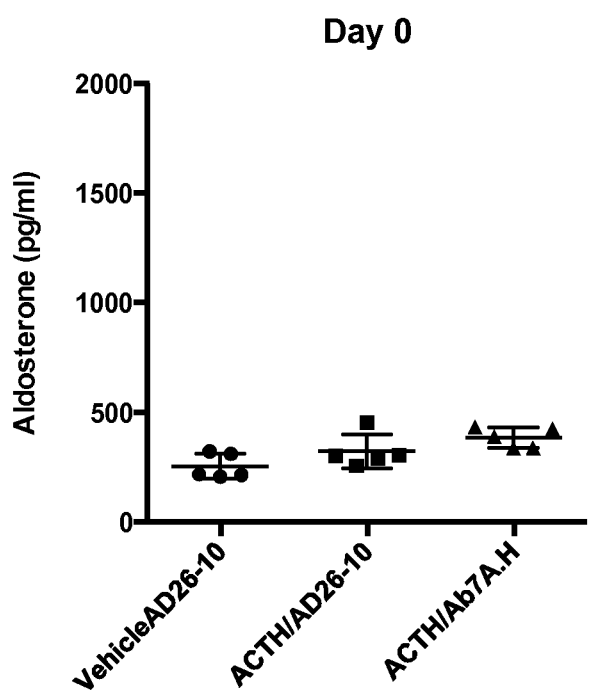
FIG. 104. Plasma aldosterone levels pre-ACTH and Ab dose

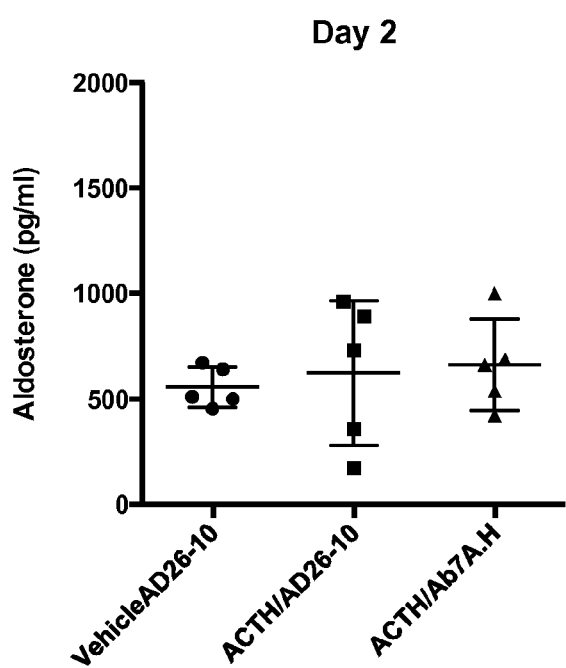
FIG. 105. Plasma aldosterone levels 24 hours post initiation of ACTH dosing and pre-Ab dose

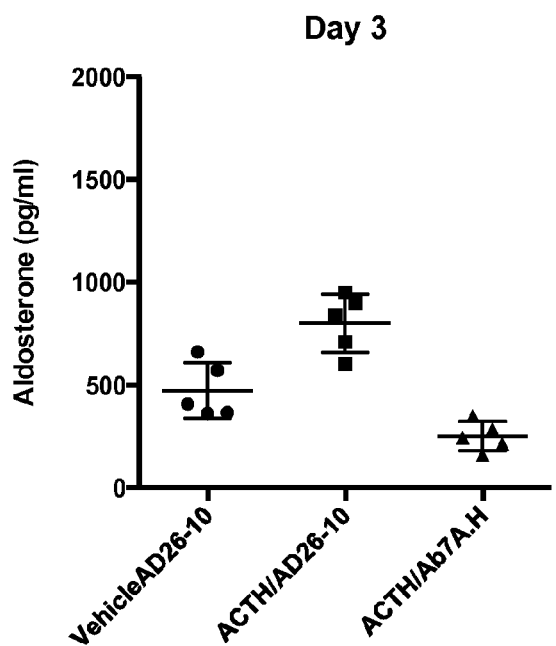
FIG. 106. Plasma aldosterone levels 48 hours post initiation of ACTH dosing and 24 hours post Ab dose

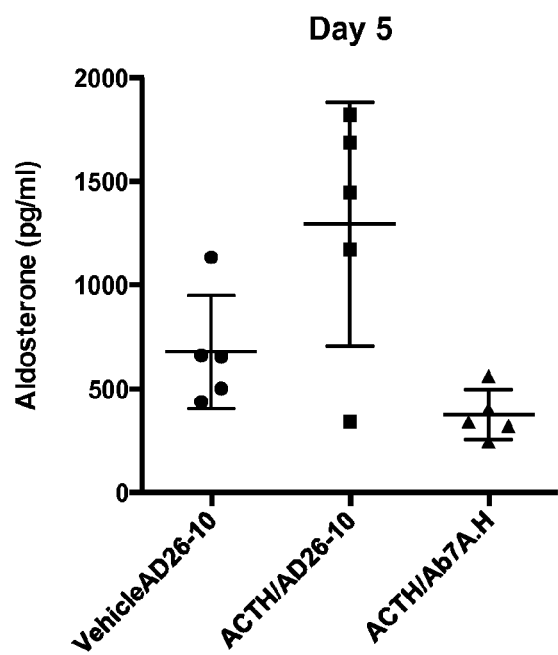
FIG. 107. Plasma aldosterone levels 96 hours post initiation of ACTH dosing and 72 hours post Ab dose

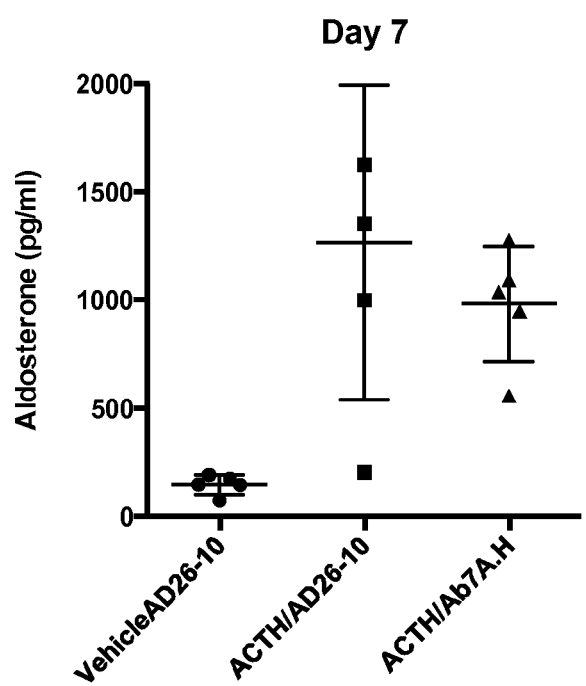
FIG. 108. Plasma aldosterone levels 144 hours post initiation of ACTH dosing and 120 hours post Ab dose

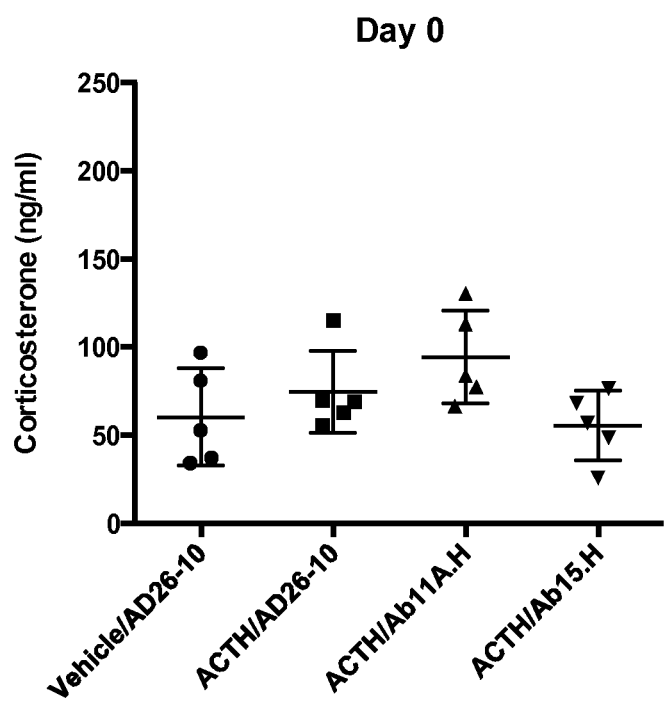
FIG. 109. Plasma corticosterone levels pre-ACTH and Ab dose

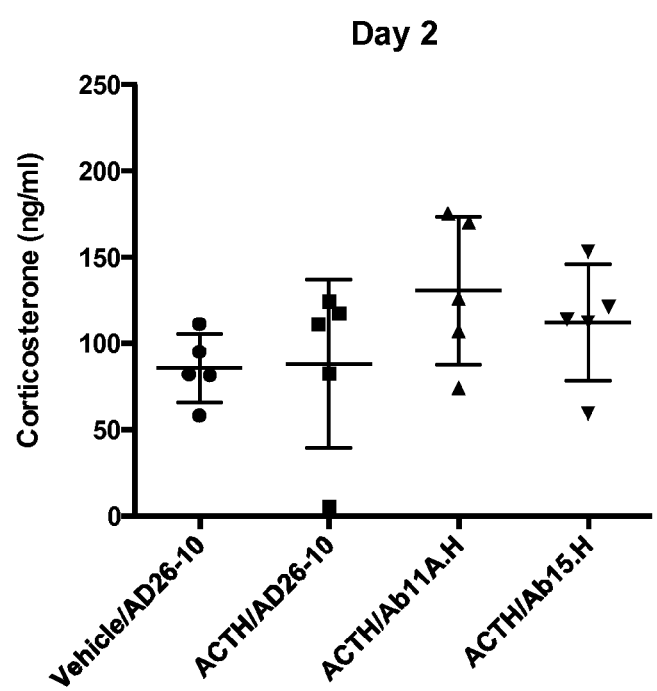
FIG. 110. Plasma corticosterone levels 24 hours post initiation of ACTH dosing and pre-Ab dose

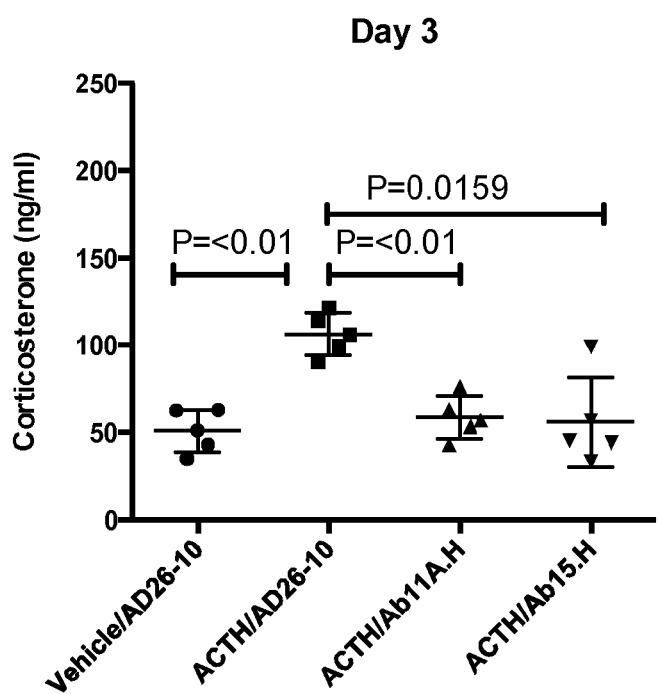
FIG. 111. Plasma corticosterone levels 48 hours post initiation of ACTH dosing and 24 hours post Ab dose

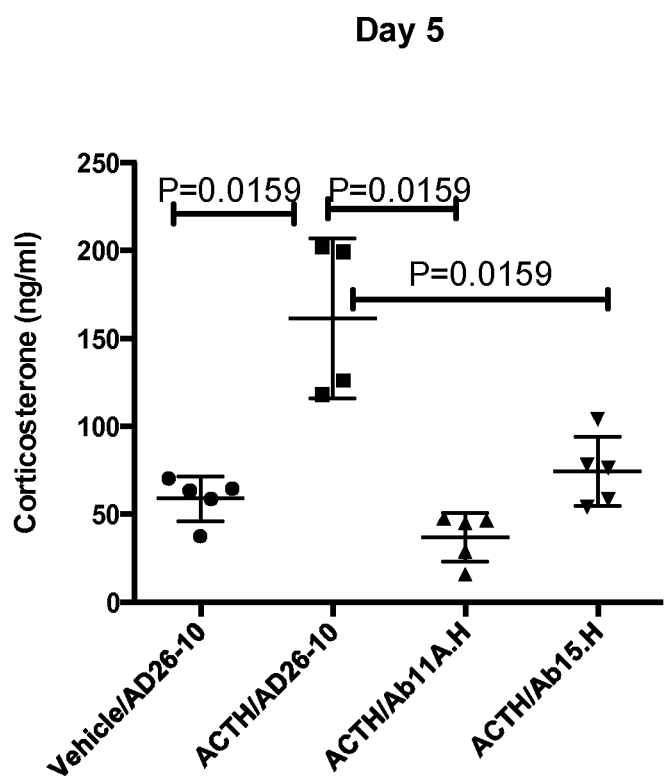
FIG. 112. Plasma corticosterone levels 96 hours post initiation of ACTH dosing and 72 hours post Ab dose

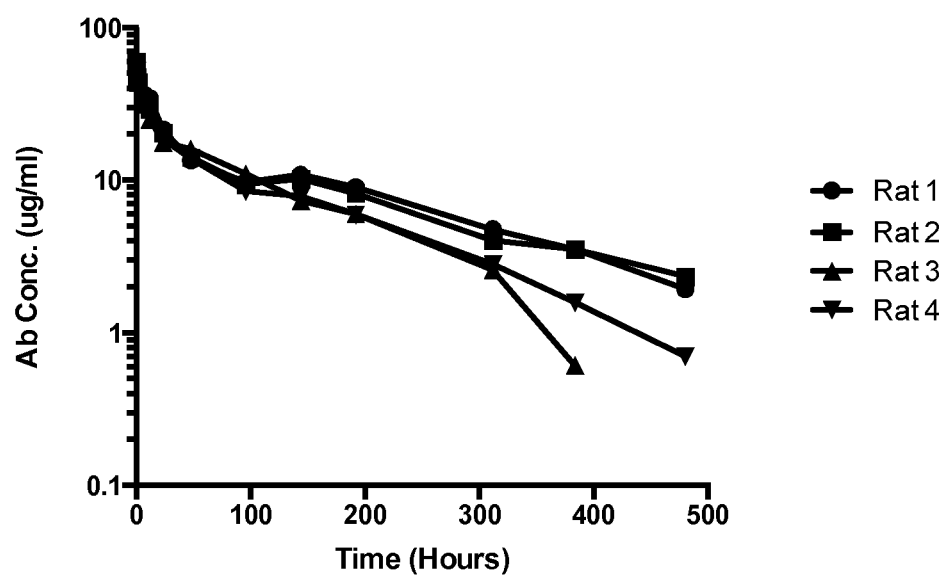
FIG. 113. Total Ab13.H antibody levels in rat plasma

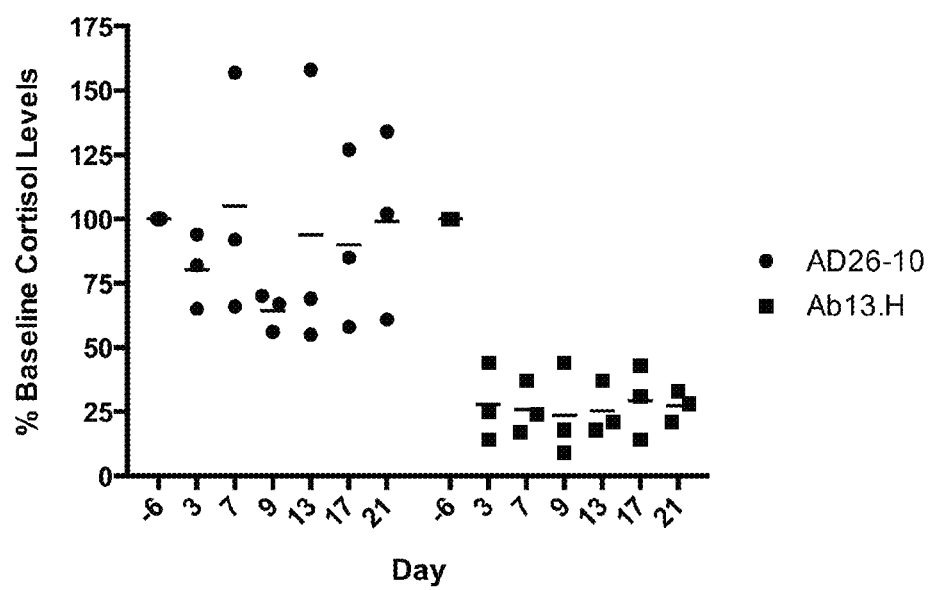
Fig. 114. Change in cortisol levels from baseline following injection of AD26-10 or Ab13.H

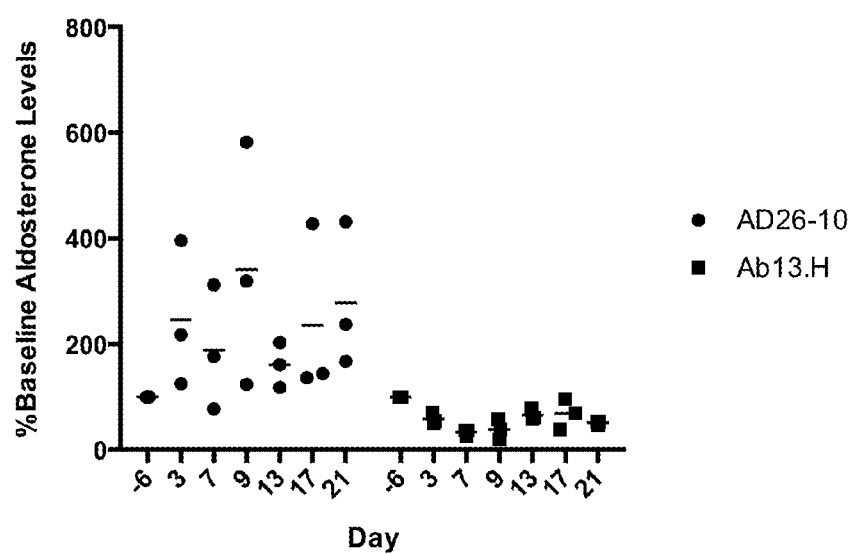
Fig. 115. Change in aldosterone levels from baseline following injection of AD26-10 or Ab13.H

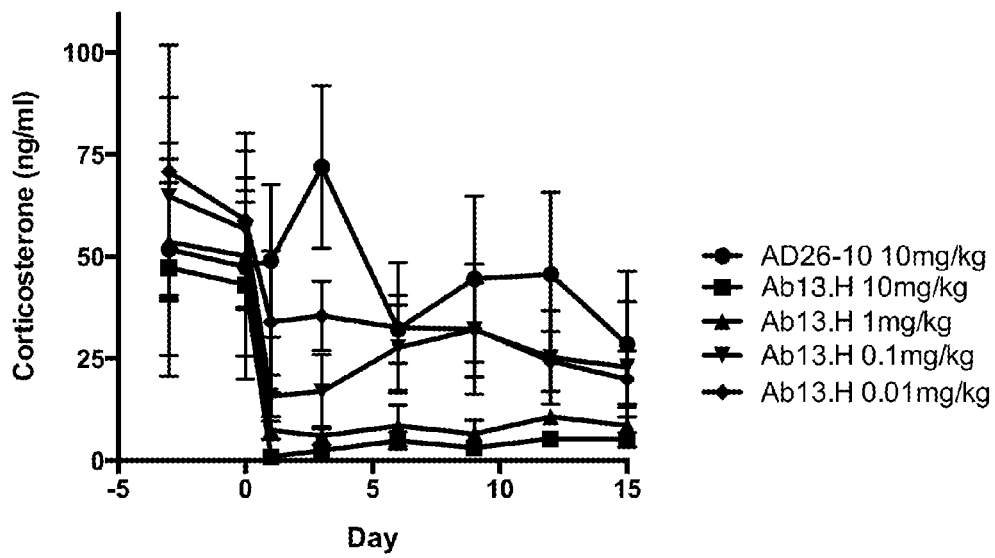
FIG. 116. Corticosterone levels in rats dosed with AD26-10 or Ab13.H
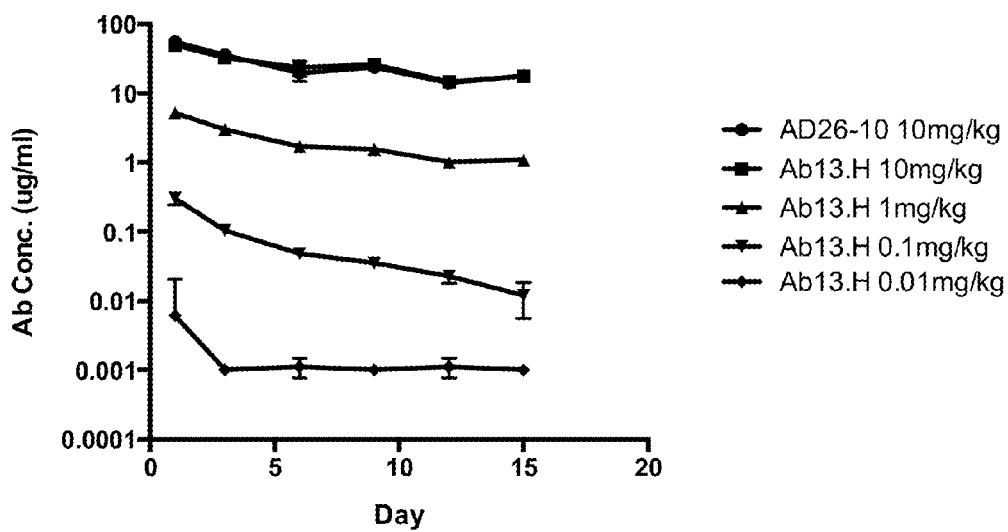
FIG. 117: Total Antibody Levels Following Administration of AD26-10 or Ab13.H

HUMANIZED ANTI-ACTH ANTIBODIES AND USE THEREOF

This application claims the benefit of U.S. Provisional Patent Application No. 62/094,805, filed Dec. 19, 2014, U.S. Provisional Patent Application No. 62/118,563, filed Feb. 20, 2015, U.S. Provisional Patent Application No. 62/207,284, filed Aug. 19, 2015, each of which is hereby incorporated by reference in its entirety.

SEQUENCE DISCLOSURE

The instant application contains a Sequence Listing, which has been submitted in ASCII format via EFS-Web and is hereby incorporated by reference in its entirety. The ASCII copy, created on Dec. 18, 2014, is named "43257o5600.txt" and is 681,004 bytes in size.

FIELD

This invention pertains to novel antibodies and antibody fragments, preferably chimeric, humanized or human antibodies and fragments thereof that specifically bind to human adrenocorticotrophic hormone (hereinafter "ACTH") and compositions containing these anti-ACTH antibodies and anti-ACTH antibody fragments. Preferably, such anti-ACTH antibodies or antibody fragments (i) will not substantially interact with (bind) a polypeptide consisting of the 13 N-terminal amino acid residues of ACTH ($ACTH_{1-13}$) and/or alpha-MSH, and/or (ii) the 22 C-terminal amino acid residues of ACTH ($ACTH_{18-39}$) (Corticotropin-Like Intermediate Peptide or CLIP). In addition, the invention relates to nucleic acids encoding said anti-ACTH antibodies and anti-ACTH antibody fragments. Further, the invention pertains to the use of said nucleic acids to express said antibodies and antibody fragments in desired host cells. Also, the invention pertains to anti-idiotypic antibodies produced against any of such antibodies.

The invention further relates to therapeutic and diagnostic uses of anti-ACTH antibodies and antibody fragments, preferably chimeric, humanized or human antibodies and antibody fragments that specifically bind to ACTH that antagonize one or more ACTH-related activities in the treatment or prophylaxis of diseases wherein the suppression of ACTH-related activities and/or the reduction of steroid, e.g., cortisol, corticosterone and/or aldosterone, levels are therapeutically or prophylactically desirable, including congenital adrenal hyperplasia (CAH), Classical CAH, Non-classical CAH, familial glucocorticoid deficiency (FGD), Cushing's disease, Cushing's Syndrome, hyperaldosteronism including primary hyperaldosteronism (such as Conn's syndrome) secondary hyperaldosteronism, and familial hyperaldosteronism, sleep apnea, obesity, diabetes, anxiety disorders, cognitive dysfunction, Alzheimer's disease, and other conditions disclosed herein. Preferably such antibodies or antibody fragments will not substantially interact with (bind) a polypeptide consisting of the 13 N-terminal amino acid residues of ACTH ($ACTH_{1-13}$) and/or alpha-MSH, or (ii) the 22 C-terminal amino acid residues of ACTH ($ACTH_{18-39}$) (CLIP).

BACKGROUND

Adrenocorticotropic hormone (ACTH), a 39 amino acid peptide, is produced by cleavage of a large precursor molecule, pro-opiomelanocortin (POMC). Post-translational enzymatic processing of POMC yields other biologically active peptides (e.g., corticotropin-like intermediate peptide (CLIP), melanocyte-stimulating hormone (MSH), and lipotrophin (LPH)) in addition to ACTH as a result of tissue-specific processing of POMC. See Bicknell, *J. Neuroendocrinology* 20: 692-99 (2008).

The POMC gene has been remarkably conserved throughout evolution. A variety of organisms have a single functional copy of the gene with the same overall gene structure. The POMC gene is predominantly expressed in the anterior and intermediate lobes of the pituitary, and it is generally accepted that the majority of POMC peptides found in the circulation are derived from the pituitary, whereas POMC peptides produced in extra-pituitary tissues (e.g., brain, lymphocytes, skin, testis, thyroid, pancreas, gut, kidney adrenal and liver) act in an autocrine or paracrine fashion. See Bicknell, *J. Neuroendocrinology* 20: 692-99 (2008).

POMC peptides, including ACTH, are believed to act primarily through melanocortin receptors (MCRs), a family of five G protein-coupled receptors (i.e., MC1R, MC2R, MC3R, MC4R and MC5R). MCRs are expressed in diverse tissues, and serve discrete physiological functions. MC1R, which is expressed on melanocytes, macrophages and adipocytes, is involved in pigmentation and inflammation. MC2R, which is expressed in the adrenal cortex, is involved in adrenal steroidogenesis. MC3R, which is expressed in the central nervous system (CNS), gastrointestinal (GI) tract and kidney, is involved in energy homeostasis and inflammation. MC4R, which is expressed in the CNS and spinal cord, is involved in energy homeostasis, appetite regulation and erectile function. MC5R, which is expressed on lymphocytes and exocrine cells, is involved in exocrine function and regulation of sebaceous glands. See Ramachandrappa et al., *Frontiers in Endocrinology* 4:19 (2013).

MC2R is reported to be unique among the MCR family for being highly specific for ACTH. See, Mountjoy K G et al., *Science* 1992; 257:1248-1251; and Schioth H B et al, *Life Sci* 1996; 59: 797-801. However, while MC3R is the only MCR with significant affinity for gamma-MSH, it can also bind alpha-MSH and ACTH with approximately equal affinity. See Gantz I, et al., *J Biol Chem* 1993; 268: 8246-8250. Also, at extremely high plasma concentrations, ACTH can bind to and activate MC1R resulting in hyperpigmentation, e.g., observed in subjects with familial glucocorticoid deficiency (FGD) (Turan et al., "An atypical case of familial glucocorticoid deficiency without pigmentation caused by coexistent homozygous mutations in MC2R (T152K) and MC1R (R160W)." *J. Clin. Endocrinol. Metab.* 97E771-E774 (2012)).

ACTH, one of the major end-products of POMC processing, is a hormone that is essential for normal steroidogenesis and the maintenance of normal adrenal weight. ACTH is secreted by the pituitary gland in response to physiological or psychological stress and its principal effects are increased production and release of corticosteroids. In particular, ACTH is secreted from corticotropes in the anterior lobe (or adenohypophysis) of the pituitary gland in response to the release of the hormone corticotropin-releasing hormone (CRH) by the hypothalamus. Once secreted, ACTH then travels to the adrenal cortex, where it binds to and activates MC2R. Activation of MC2R results in the production of cAMP in the adrenal cell. cAMP binds and activates protein kinase (PKA), which activates the conversion of the lipid cholesterol to the steroid hormone cortisol.

Cortisol is a hormone that affects numerous biological processes in order to restore homeostasis after stress. Exemplary processes regulated by cortisol include regulating glucose homeostasis, increasing blood pressure, gluconeogenesis, promoting metabolism of glycogen, lipids, and proteins, and suppressing the immune system. Under normal physiological conditions, cortisol levels are tightly regulated. However, in some conditions (including diseases and disorders further described herein), cortisol levels are elevated. The overproduction of cortisol has been shown to have many negative effects, such as damaging the hippocampus, a region of the brain that is critical for cognitive functions and regulation of the hypothalamus/pituitary/adrenal axis; increasing fat deposits, blood pressure levels, and blood sugar levels; bone loss; muscle weakness; and suppression of the immune system. Therefore, elevated cortisol levels may play a role in ACTH-driven hypercortisolism (such as Cushing's Disease or Cushing's Syndrome), obesity, diabetes, sleep apnea, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophies, hypertension, cognitive dysfunction, galactorrhea and metabolic syndromes.

Aldosterone is a hormone released by the adrenal glands that helps regulate blood pressure. In particular, aldosterone increases the reabsorption of sodium and water and the release of potassium in the kidneys. In some disease conditions, aldosterone levels are elevated. For example, primary and secondary hyperaldosteronism occur when the adrenal gland releases too much of the hormone aldosterone. Primary hyperaldosteronism such as Conn's syndrome results from a problem with the adrenal gland itself that causes the release of too much aldosterone, whereas the excess aldosterone in secondary hyperaldosteronism is caused by something outside the adrenal gland that mimics the primary condition, e.g., by causing the adrenal gland to release too much aldosterone. Primary hyperaldosteronism used to be considered a rare condition, but some experts believe that it may be the cause of high blood pressure in some patients. Most cases of primary hyperaldosteronism are caused by a noncancerous (benign) tumor of the adrenal gland. The condition is most common in people ages 30-50 years. Secondary hyperaldosteronism is frequently due to high blood pressure and it may also be related to disorders such as cirrhosis of the liver, heart failure, and nephrotic syndrome. Therefore, elevated aldosterone levels may play a role in hyperaldosteronism including primary hyperaldosteronism (such as Conn's syndrome), secondary hyperaldosteronism and familial hyperaldosteronism.

SUMMARY

The invention in general relates to human, humanized or chimerized anti-human adrenocorticotrophic hormone ("ACTH") antibodies or antibody fragments. In one embodiment, the human, humanized or chimerized anti-ACTH antibody or antibody fragment does not substantially interact with (i.e., bind to) a polypeptide consisting of: (i) the 13 N-terminal amino acid residues of ACTH ($ACTH_{1-13}$) and/or alpha-MSH, and/or (ii) the 22 C-terminal amino acid residues of ACTH ($ACTH_{18-39}$).

The human, humanized or chimerized anti-ACTH antibody or antibody fragment may be selected from the group consisting of scFvs, camelbodies, nanobodies, IgNAR, Fab fragments, Fab' fragments, MetMab like antibodies, monovalent antibody fragments, and F(ab')$_2$ fragments. Additionally, the human, humanized or chimerized anti-ACTH antibody or antibody fragment may substantially or entirely lack N-glycosylation and/or O-glycosylation. In one embodiment, the human, humanized or chimerized anti-ACTH antibody or antibody fragment comprises a human constant domain, e.g., an IgG1, IgG2, IgG3, or IgG4 antibody. In another embodiment, the human, humanized or chimerized anti-ACTH antibody or antibody fragment comprises an Fc region that has been modified to alter at least one of effector function, half-life, proteolysis, or glycosylation. For example, the Fc region may contain one or more mutations that alters or eliminates N- and/or O-glycosylation.

In one embodiment, the human, humanized or chimerized anti-ACTH antibody or antibody fragment binds to ACTH with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M. Preferably, the human, humanized or chimerized anti-ACTH antibody or antibody fragment binds to ACTH with a $K_D$ of less than or equal to $5\times10^{-10}$ M, $10^{-10}$ M, $5\times10^{-11}$ M, $10^{-11}$ M, $5\times10^{-12}$ M, or $10^{-12}$ M. More preferably, the human, humanized or chimerized anti-ACTH antibody or antibody fragment binds to ACTH with a $K_D$ that is less than about 100 nM, less than about 10 nM, less than about 1 nM, less than about 100 pM, less than about 50 pM, less than about 40 pM, less than about 25 pM, less than about 1 pM, between about 10 pM and about 100 pM, between about 1 pM and about 100 pM, or between about 1 pM and about 10 pM. In exemplary embodiments the $K_D$ value may be detected by surface plasmon resonance (e.g., BIAcore®) at 25 or 37° C. However, other methods such as ELISA and KINEXA may alternatively be used.

In another embodiment, the human, humanized or chimerized anti-ACTH antibody or antibody fragment binds to ACTH with an off-rate ($k_d$) of less than or equal to $5\times10^{-4}$ s$^{-1}$, $10^{-4}$ s$^{-1}$, $5\times10^5$ s$^{-1}$, or $10^{-5}$ s$^{-1}$.

In yet another embodiment, the human, humanized or chimerized anti-human ACTH antibody or antibody fragment that specifically binds to the linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab2.H or Ab13.H. In particular, the human, humanized or chimerized anti-human ACTH antibody or antibody fragment specifically binds to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab2.H or Ab13.H. The epitope(s) may be identified using a binding assay that detects the binding of said anti-human ACTH antibody or antibody fragment to one or more peptides in a library of overlapping linear peptide fragments that span the full length of human ACTH. Preferably, the epitope is identified using alanine scanning mutation strategy.

In some embodiments, the human, humanized or chimerized anti-human ACTH antibody or antibody fragment contains at least 2 complementarity determining regions (CDRs), at least 3 CDRs, at least 4 CDRs, at least 5 CDRs or all six CDRs of an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H. In exemplary embodiments, the antibody or fragment will retain the $V_H$ CDR3 and/or the $V_L$ CDR3 of one of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, or Ab17.H.

In a specific embodiment, the human, humanized or chimerized anti-human ACTH antibody or antibody fragment comprises (a) a variable heavy chain comprising a CDR1 sequence consisting of SEQ ID NO:4; a CDR2 sequence consisting of SEQ ID NO:6; and a CDR3 sequence consisting of SEQ ID NO:8; and/or (b) a variable light chain comprising a CDR1 sequence consisting of SEQ ID NO:24; a CDR2 sequence consisting of SEQ ID NO:26; and a CDR3 sequence consisting of SEQ ID NO:28. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:2 and/or (b) a variable light chain comprising an amino acid sequence with at least 80, 85, 90, 95, 96, 97, 98, or 99% sequence identity to SEQ ID NO:22. Preferably, the anti-human ACTH antibody or antibody fragment comprises (a) a variable heavy chain having the amino acid sequence of SEQ ID NO:2, and/or (b) a variable light chain having the amino acid sequence of SEQ ID NO:22. More specifically, the anti-human ACTH antibody or antibody fragment may comprise (a) a heavy chain having the amino acid sequence of SEQ ID NO: 1, and/or (b) a light chain having the amino acid sequence of SEQ ID NO:21.

In another specific embodiment, the human, humanized or chimerized anti-human ACTH antibody or antibody fragment comprises (a) a variable heavy chain comprising a CDR1 sequence consisting of SEQ ID NO:44; a CDR2 sequence consisting of SEQ ID NO:46; and a CDR3 sequence consisting of SEQ ID NO:48; and/or (b) a variable light chain comprising a CDR1 sequence consisting of SEQ ID NO:64; a CDR2 sequence consisting of SEQ ID NO:66; and a CDR3 sequence consisting of SEQ ID NO:68. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:42, and/or (b) a variable light chain comprising an amino acid sequence with at least 80, 85, 90, 95, 96, 97, 98, or 99% sequence identity to SEQ ID NO:62. Preferably, the anti-human ACTH antibody or antibody fragment comprises (a) a variable heavy chain having the amino acid sequence of SEQ ID NO:42, and/or (b) a variable light chain having the amino acid sequence of SEQ ID NO:62. More specifically, the anti-human ACTH antibody or antibody fragment may comprise (a) a heavy chain having the amino acid sequence of SEQ ID NO:41, and/or (b) a light chain having the amino acid sequence of SEQ ID NO:61.

In another specific embodiment, the human, humanized or chimerized anti-human ACTH antibody or antibody fragment comprises (a) a variable heavy chain comprising a CDR1 sequence consisting of SEQ ID NO:84; a CDR2 sequence consisting of SEQ ID NO:86; and a CDR3 sequence consisting of SEQ ID NO:88; and/or (b) a variable light chain comprising a CDR1 sequence consisting of SEQ ID NO: 104; a CDR2 sequence consisting of SEQ ID NO: 106; and a CDR3 sequence consisting of SEQ ID NO: 108. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:82, and/or (b) a variable light chain comprising an amino acid sequence with at least 80, 85, 90, 95, 96, 97, 98, or 99% sequence identity to SEQ ID NO: 102. Preferably, the anti-human ACTH antibody or antibody fragment comprises (a) a variable heavy chain having the amino acid sequence of SEQ ID NO:82, and/or (b) a variable light chain having the amino acid sequence of SEQ ID NO: 102. More specifically, the anti-human ACTH antibody or antibody fragment comprises (a) a heavy chain having the amino acid sequence of SEQ ID NO:81, and/or (b) a light chain having the amino acid sequence of SEQ ID NO:101.

In another specific embodiment, the human, humanized or chimerized anti-human ACTH antibody or antibody fragment comprises (a) a variable heavy chain comprising a CDR1 sequence consisting of SEQ ID NO: 124; a CDR2 sequence consisting of SEQ ID NO: 126; and a CDR3 sequence consisting of SEQ ID NO: 128; and/or (b) a variable light chain comprising a CDR1 sequence consisting of SEQ ID NO: 144; a CDR2 sequence consisting of SEQ ID NO: 146; and a CDR3 sequence consisting of SEQ ID NO: 148. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO: 122 and/or (b) a variable light chain comprising an amino acid sequence with at least 80, 85, 90, 95, 96, 97, 98, or 99% sequence identity to SEQ ID NO: 142. Preferably, the anti-human ACTH antibody or antibody fragment comprises (a) a variable heavy chain having the amino acid sequence of SEQ ID NO: 122, and/or (b) a variable light chain having the amino acid sequence of SEQ ID NO: 142. More specifically, the anti-human ACTH antibody or antibody fragment comprises (a) a heavy chain having the amino acid sequence of SEQ ID NO: 121, and/or (b) a light chain having the amino acid sequence of SEQ ID NO: 141.

In another specific embodiment, the human, humanized or chimerized anti-human ACTH antibody or antibody fragment comprises (a) a variable heavy chain comprising a CDR1 sequence consisting of SEQ ID NO: 164; a CDR2 sequence consisting of SEQ ID NO: 166; and a CDR3 sequence consisting of SEQ ID NO: 168; and/or (b) a variable light chain comprising a CDR1 sequence consisting of SEQ ID NO: 184; a CDR2 sequence consisting of SEQ ID NO: 186; and a CDR3 sequence consisting of SEQ ID NO: 188. Alternatively, the anti-human ACTH antibody or antibody fragment may comprises (a) a variable heavy chain comprising an amino acid sequence with at least 80, 85, 90, 95, 96, 97, 98, or 99% sequence identity to SEQ ID NO:162, and/or (b) a variable light chain comprising an amino acid sequence with at least 80, 85, 90, 95, 96, 97, 98, or 99% sequence identity to SEQ ID NO:182. Preferably, the anti-human ACTH antibody or antibody fragment comprises (a) a variable heavy chain having the amino acid sequence of SEQ ID NO: 162, and/or (b) a variable light chain having the amino acid sequence of SEQ ID NO:182. More specifically, the anti-human ACTH antibody or antibody fragment comprises (a) a heavy chain having the amino acid sequence of SEQ ID NO:161, and/or (b) a light chain having the amino acid sequence of SEQ ID NO:181.

In another specific embodiment, the human, humanized or chimerized anti-human ACTH antibody or antibody fragment comprises (a) a variable heavy chain comprising a CDR1 sequence consisting of SEQ ID NO:204; a CDR2 sequence consisting of SEQ ID NO:206; and a CDR3 sequence consisting of SEQ ID NO:208; and/or (b) a variable light chain comprising a CDR1 sequence consisting of SEQ ID NO:224; a CDR2 sequence consisting of SEQ ID NO:226; and a CDR3 sequence consisting of SEQ ID NO:228. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:202 and/or (b) a variable light chain comprising an amino acid sequence with at least 80, 85, 90, 95, 96, 97, 98, or 99% sequence identity to SEQ ID NO:222. Preferably, the anti-human ACTH antibody or antibody fragment comprises (a) a variable heavy chain having the amino acid sequence of SEQ ID NO:202, and/or (b) a variable light chain having the amino acid sequence of SEQ ID NO:222. More specifically, the anti-human ACTH antibody or antibody fragment comprises (a) a heavy chain having the amino acid sequence of SEQ ID NO:201, and/or (b) a light chain having the amino acid sequence of SEQ ID NO:221.

In another specific embodiment, the human, humanized or chimerized anti-human ACTH antibody or antibody fragment comprises (a) a variable heavy chain comprising a CDR1 sequence consisting of SEQ ID NO:244; a CDR2 sequence consisting of SEQ ID NO:246; and a CDR3 sequence consisting of SEQ ID NO:248; and/or (b) a variable light chain comprising a CDR1 sequence consisting of SEQ ID NO:264; a CDR2 sequence consisting of SEQ ID NO:266; and a CDR3 sequence consisting of SEQ ID NO:268. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:242 and/or (b) a variable light chain comprising an amino acid sequence with at least 80, 85, 90, 95, 96, 97, 98, or 99% sequence identity to SEQ ID NO:262. Preferably, the anti-human ACTH antibody or antibody fragment comprises (a) a variable heavy chain having the amino acid sequence of SEQ ID NO:242, and/or (b) a variable light chain having the amino acid sequence of SEQ ID NO:262. More specifically, the anti-human ACTH antibody or antibody fragment comprises (a) a heavy chain having the amino acid sequence of SEQ ID NO:241, and/or (b) a light chain having the amino acid sequence of SEQ ID NO:261.

In another specific embodiment, the human, humanized or chimerized anti-human ACTH antibody or antibody fragment comprises (a) a variable heavy chain comprising a CDR1 sequence consisting of SEQ ID NO:284; a CDR2 sequence consisting of SEQ ID NO:286; and a CDR3 sequence consisting of SEQ ID NO:288; and/or (b) a variable light chain comprising a CDR1 sequence consisting of SEQ ID NO:304; a CDR2 sequence consisting of SEQ ID NO:306; and a CDR3 sequence consisting of SEQ ID NO:308. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:282, and/or a variable light chain comprising an amino acid sequence with at least 80, 85, 90, 95, 96, 97, 98, or 99% sequence identity to SEQ ID NO:302. Preferably, the anti-human ACTH antibody or antibody fragment comprises (a) a variable heavy chain having the amino acid sequence of SEQ ID NO:282, and/or (b) a variable light chain having the amino acid sequence of SEQ ID NO:302. More specifically, the anti-human ACTH antibody or antibody fragment comprises (a) a heavy chain having the amino acid sequence of SEQ ID NO:281, and/or (b) a light chain having the amino acid sequence of SEQ ID NO:301.

In another specific embodiment, the human, humanized or chimerized anti-human ACTH antibody or antibody fragment comprises (a) a variable heavy chain comprising a CDR1 sequence consisting of SEQ ID NO:324; a CDR2 sequence consisting of SEQ ID NO:326; and a CDR3 sequence consisting of SEQ ID NO:328; and/or (b) a variable light chain comprising a CDR1 sequence consisting of SEQ ID NO:344; a CDR2 sequence consisting of SEQ ID NO:346; and a CDR3 sequence consisting of SEQ ID NO:348. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:322, and/or a variable light chain comprising an amino acid sequence with at least 80, 85, 90, 95, 96, 97, 98, or 99% sequence identity to SEQ ID NO:342. Preferably, the anti-human ACTH antibody or antibody fragment comprises (a) a variable heavy chain having the amino acid sequence of SEQ ID NO:322, and/or (b) a variable light chain having the amino acid sequence of SEQ ID NO:342. More specifically, the anti-human ACTH antibody or antibody fragment comprises (a) a heavy chain having the amino acid sequence of SEQ ID NO:321, and/or (b) a light chain having the amino acid sequence of SEQ ID NO:341.

In another specific embodiment, the human, humanized or chimerized anti-human ACTH antibody or antibody fragment comprises (a) a variable heavy chain comprising a CDR1 sequence consisting of SEQ ID NO:364; a CDR2 sequence consisting of SEQ ID NO:366; and a CDR3 sequence consisting of SEQ ID NO:368; and/or (b) a variable light chain comprising a CDR1 sequence consisting of SEQ ID NO:384; a CDR2 sequence consisting of SEQ ID NO:386; and a CDR3 sequence consisting of SEQ ID NO:388. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:362, and/or a variable light chain comprising an amino acid sequence with at least 80, 85, 90, 95, 96, 97, 98, or 99% sequence identity to SEQ ID NO:382. Preferably, the anti-human ACTH antibody or antibody fragment comprises (a) a variable heavy chain having the amino acid sequence of SEQ ID NO:362, and/or (b) a variable light chain having the amino acid sequence of SEQ ID NO:382. More specifically, the anti-human ACTH antibody or antibody fragment comprises (a) a heavy chain having the amino acid sequence of SEQ ID NO:361, and/or (b) a light chain having the amino acid sequence of SEQ ID NO:381.

In another specific embodiment, the human, humanized or chimerized anti-human ACTH antibody or antibody fragment comprises (a) a variable heavy chain comprising a CDR1 sequence consisting of SEQ ID NO:404; a CDR2 sequence consisting of SEQ ID NO:406; and a CDR3 sequence consisting of SEQ ID NO:408; and/or (b) a variable light chain comprising a CDR1 sequence consisting of SEQ ID NO:424; a CDR2 sequence consisting of SEQ ID NO:426; and a CDR3 sequence consisting of SEQ ID NO:428. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:402, and/or a variable light chain comprising an amino acid sequence with at least 80, 85, 90, 95, 96, 97, 98, or 99% sequence identity to SEQ ID NO:422. Preferably, the anti-human ACTH antibody or antibody fragment comprises (a) a variable heavy chain having the amino acid sequence of SEQ ID NO:402, and/or (b) a variable light chain having the amino acid sequence of SEQ ID NO:422. More specifically, the anti-human ACTH antibody or antibody fragment comprises (a) a heavy chain having the amino acid sequence of SEQ ID NO:401, and/or (b) a light chain having the amino acid sequence of SEQ ID NO:421.

In another specific embodiment, the human, humanized or chimerized anti-human ACTH antibody or antibody fragment comprises (a) a variable heavy chain comprising a CDR1 sequence consisting of SEQ ID NO:444; a CDR2 sequence consisting of SEQ ID NO:446; and a CDR3 sequence consisting of SEQ ID NO:448; and/or (b) a variable light chain comprising a CDR1 sequence consisting of SEQ ID NO:464; a CDR2 sequence consisting of SEQ ID NO:466; and a CDR3 sequence consisting of SEQ ID NO:468. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:442 and/or (b) a variable light chain comprising an amino acid sequence with at least 80, 85, 90, 95, 96, 97, 98, or 99% sequence identity to SEQ ID NO:462. Preferably, the anti-human ACTH antibody or antibody fragment comprises (a) a variable heavy chain having the amino acid sequence of SEQ ID NO:442, and/or (b) a variable light chain having the amino acid sequence of SEQ ID NO:462. More specifically, the anti-human ACTH antibody or antibody fragment comprises (a) a heavy chain having the amino acid sequence of SEQ ID NO:441, and/or (b) a light chain having the amino acid sequence of SEQ ID NO:461.

In another specific embodiment, the human, humanized or chimerized anti-human ACTH antibody or antibody fragment comprises (a) a variable heavy chain comprising a CDR1 sequence consisting of SEQ ID NO:484; a CDR2 sequence consisting of SEQ ID NO:486; and a CDR3 sequence consisting of SEQ ID NO:488; and/or (b) a variable light chain comprising a CDR1 sequence consisting of SEQ ID NO:504; a CDR2 sequence consisting of SEQ ID NO:506; and a CDR3 sequence consisting of SEQ ID NO:508. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:482, and/or a variable light chain comprising an amino acid sequence with at least 80, 85, 90, 95, 96, 97, 98, or 99% sequence identity to SEQ ID NO:502. Preferably, the anti-human ACTH antibody or antibody fragment comprises (a) a variable heavy chain having the amino acid sequence of SEQ ID NO:482, and/or (b) a variable light chain having the amino acid sequence of SEQ ID NO:502. More specifically, the anti-human ACTH antibody or antibody fragment comprises (a) a heavy chain having the amino acid sequence of SEQ ID NO:481, and/or (b) a light chain having the amino acid sequence of SEQ ID NO:501.

In another specific embodiment, the human, humanized or chimerized anti-human ACTH antibody or antibody fragment comprises (a) a variable heavy chain comprising a CDR1 sequence consisting of SEQ ID NO:524; a CDR2 sequence consisting of SEQ ID NO:526; and a CDR3 sequence consisting of SEQ ID NO:528; and/or (b) a variable light chain comprising a CDR1 sequence consisting of SEQ ID NO:544; a CDR2 sequence consisting of SEQ ID NO:546; and a CDR3 sequence consisting of SEQ ID NO:548. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:522, and/or a variable light chain comprising an amino acid sequence with at least 80, 85, 90, 95, 96, 97, 98, or 99% sequence identity to SEQ ID NO:542. Preferably, the anti-human ACTH antibody or antibody fragment comprises (a) a variable heavy chain having the amino acid sequence of SEQ ID NO:522, and/or (b) a variable light chain having the amino acid sequence of SEQ ID NO:542. More specifically, the anti-human ACTH antibody or antibody fragment comprises (a) a heavy chain having the amino acid sequence of SEQ ID NO:521, and/or (b) a light chain having the amino acid sequence of SEQ ID NO:541.

In another specific embodiment, the human, humanized or chimerized anti-human ACTH antibody or antibody fragment comprises (a) a variable heavy chain comprising a CDR1 sequence consisting of SEQ ID NO:564; a CDR2 sequence consisting of SEQ ID NO:566; and a CDR3 sequence consisting of SEQ ID NO:568; and/or (b) a variable light chain comprising a CDR1 sequence consisting of SEQ ID NO:584; a CDR2 sequence consisting of SEQ ID NO:586; and a CDR3 sequence consisting of SEQ ID NO:588. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:562, and/or a variable light chain comprising an amino acid sequence with at least 80, 85, 90, 95, 96, 97, 98, or 99% sequence identity to SEQ ID NO:582. Preferably, the anti-human ACTH antibody or antibody fragment comprises (a) a variable heavy chain having the amino acid sequence of SEQ ID NO:562, and/or (b) a variable light chain having the amino acid sequence of SEQ ID NO:582. More specifically, the anti-human ACTH antibody or antibody fragment comprises (a) a heavy chain having the amino acid sequence of SEQ ID NO:561, and/or (b) a light chain having the amino acid sequence of SEQ ID NO:581.

In another specific embodiment, the human, humanized or chimerized anti-human ACTH antibody or antibody fragment comprises (a) a variable heavy chain comprising a CDR1 sequence consisting of SEQ ID NO:604; a CDR2 sequence consisting of SEQ ID NO:606; and a CDR3 sequence consisting of SEQ ID NO:608; and/or (b) a variable light chain comprising a CDR1 sequence consisting of SEQ ID NO:624; a CDR2 sequence consisting of SEQ ID NO:626; and a CDR3 sequence consisting of SEQ ID NO:628. Alternatively, the anti-human ACTH antibody or antibody fragment may comprise a variable heavy chain comprising an amino acid sequence with at least 80, 85, 90, 95, 96, 97, 98, or 99% sequence identity to SEQ ID NO:602, and/or a variable light chain comprising an amino acid sequence with at least 80, 85, 90, 95, 96, 97, 98, or 99% sequence identity to SEQ ID NO:622. Preferably, the anti-human ACTH antibody or antibody fragment comprises (a) a variable heavy chain having the amino acid sequence of SEQ ID NO:602, and/or (b) a variable light chain having the amino acid sequence of SEQ ID NO:622. More specifically, the anti-human ACTH antibody or antibody fragment comprises (a) a heavy chain having the amino acid sequence of SEQ ID NO:601, and/or (b) a light chain having the amino acid sequence of SEQ ID NO:621.

In another specific embodiment, the human, humanized or chimerized anti-human ACTH antibody or antibody fragment comprises (a) a variable heavy chain comprising a CDR1 sequence consisting of SEQ ID NO:644; a CDR2 sequence consisting of SEQ ID NO:646; and a CDR3 sequence consisting of SEQ ID NO:648; and/or (b) a variable light chain comprising a CDR1 sequence consisting of SEQ ID NO:664; a CDR2 sequence consisting of SEQ ID NO:666; and a CDR3 sequence consisting of SEQ ID NO:668. Alternatively, the anti-human ACTH antibody or antibody fragment may comprise (a) a variable heavy chain comprising an amino acid sequence with at least 80, 85, 90, 95, 96, 97, 98, or 99% sequence identity to SEQ ID NO:642 and/or (b) a variable light chain comprising an amino acid sequence with at least 80, 85, 90, 95, 96, 97, 98, or 99% sequence identity to SEQ ID NO:662. Preferably, the anti-human ACTH antibody or antibody fragment comprises (a) a variable heavy chain having the amino acid sequence of SEQ ID NO:642, and/or (b) a variable light chain having the amino acid sequence of SEQ ID NO:662. More specifically, the anti-human ACTH antibody or antibody fragment comprises (a) a heavy chain having the amino acid sequence of SEQ ID NO:641, and/or (b) a light chain having the amino acid sequence of SEQ ID NO:661.

In one embodiment, the anti-human ACTH antibody or antibody fragments are selected from the group consisting of chimeric, humanized, and human antibodies or antibody fragments, preferably human, humanized or chimerized antibodies or antibody fragments, which may be selected from the group consisting of scFvs, camelbodies, nanobodies, IgNAR, Fab fragments, Fab' fragments, MetMab like antibodies, monovalent antibody fragments, and F(ab')$_2$ fragments.

The anti-human ACTH antibody or antibody fragment may substantially or entirely lack N-glycosylation and/or O-glycosylation. The anti-human ACTH antibody or antibody fragment may comprise a human constant domain, e.g., IgG1, IgG2, IgG3, or IgG4. In one aspect, the anti-human ACTH antibody or antibody fragment comprises an Fc region that has been modified to alter at least one of effector function, half-life, proteolysis, or glycosylation. For example, the Fc region may contain one or more mutations that alters or eliminates N- and/or O-glycosylation.

In another embodiment, the anti-human ACTH antibody or antibody fragment is directly or indirectly attached to another moiety, such as a detectable label or therapeutic agent.

In another embodiment, the anti-human ACTH antibody or antibody fragment inhibits or neutralizes at least one biological effect elicited by ACTH when such antibody is administered to a human subject. For example, the antibody or antibody fragment is capable of inhibiting the binding of ACTH to an MCR, i.e., MC1R MC2R, MC3R, MC4R and/or MC5R. Preferably, the anti-human ACTH antibody or antibody fragment neutralizes or inhibits ACTH activation of MC2R; at least one of MC1R, MC2R, MC3R, MC4R and MC5R; at least one of MC2R, MC3R, and MC4R; each of MC2R, MC3R, and MC4R; or each of MC1R, MC2R, MC3R, MC4R and MC5R.

In one embodiment, the anti-human ACTH antibody or antibody fragment inhibits ACTH-induced cortisol, corticosterone and/or aldosterone secretion. The anti-human ACTH antibody or antibody fragment, when administered to a human subject, can also reduce plasma cortisol, corticosterone, and/or aldosterone levels.

In one embodiment, the anti-human ACTH antibody or antibody fragment binds to ACTH with a $K_D$ that is less than about 100 nM, less than about 10 nM, less than about 1 nM, less than about 100 pM, less than about 50 pM, less than about 40 pM, less than about 25 pM, less than about 1 pM, between about 10 pM and about 100 pM, between about 1 pM and about 100 pM, or between about 1 pM and about 10 pM.

Preferably, the anti-human ACTH antibody or antibody fragment has stronger affinity for ACTH$_{1-39}$ as compared to alpha-MSH or CLIP, i.e., although there is some cross-reactivity, the antibodies preferentially bind to ACTH$_{1-39}$ as compared to alpha-MSH or CLIP. For example, the affinity of said antibody or antibody fragment to ACTH$_{1-39}$ is at least 10-fold, 100-fold, 1000-fold or stronger than the affinity of said antibody or antibody fragment to alpha-MSH or CLIP (e.g., the $K_D$ of said antibody or fragment for binding to human ACTH is 10-, 100-, or 1000-fold lower than the $K_D$ for binding to alpha-MSH or CLIP).

More preferably, for example, the anti-human ACTH antibody or antibody fragment binds to ACTH$_{1-39}$ but does not bind to alpha-MSH.

In one embodiment, the anti-human ACTH antibody or antibody fragment is attached to at least one effector moiety, e.g., which comprises a chemical linker. In another embodiment, the anti-human ACTH antibody or antibody fragment is attached to one or more detectable moieties, e.g., which comprises a fluorescent dye, enzyme, substrate, bioluminescent material, radioactive material, chemiluminescent moiety, or mixtures thereof.

In one embodiment, the anti-human ACTH antibody or antibody fragment is attached to one or more functional moieties.

The invention also contemplates antibodies, e.g., anti-idiotypic antibodies, produced against an anti-human ACTH antibody or antibody fragment as described above. Furthermore, the invention provides a method of using the anti-idiotypic antibody to monitor the in vivo levels of said anti-ACTH antibody or antibody fragment in a subject or to neutralize said anti-ACTH antibody in a subject being administered said anti-ACTH antibody or antibody fragment.

Moreover, the present invention encompasses a composition suitable for therapeutic, prophylactic, or a diagnostic use comprising a therapeutically, prophylactically or diagnostically effective amount of at least one anti-human ACTH antibody or antibody fragment as described herein. The composition may be suitable for subcutaneous administration, intravenous administration, and/or topical administration. The composition may be lyophilized. In some embodiments, the composition further comprises a pharmaceutically acceptable diluent, carrier, solubilizer, emulsifier, preservative, or mixture thereof. Additionally, in some embodiments, the composition further comprises another active agent, e.g., selected from the group consisting of ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), and satavaptan (SR121463, planned trade name Aquilda®), mifepristone (Korlym®), armodafinil (Nuvigil®) and modafinil (Provigil®). Additionally, in other embodiments, the composition may be used in conjunction with supplemental oxygen, continuous positive airway pressure (CPAP), bilevel positive airway pressure (BPAP), expiratory positive airway pressure (EPAP), adaptive servo-ventilation (ASV), oral appliances, uvulopalatopharyngoplasty (UPPP), maxillomandibular advancement, nasal surgery, and removal of tonsils and/or adenoids to treat sleep apnea.

In some embodiments, a composition containing the subject antibody may further comprise another active agent, or a therapeutic regimen comprising administration of the subject antibody may include administration of at least one other agent. Said other agent or agents may be an agent that treats a condition associated with ACTH, such as ACTH-driven hypercortisolism, acute coronary syndrome, acute heart failure, Alzheimer's disease, anxiety disorders, atherosclerosis, atrial fibrillation, cachexia, cancer (such as Cushing's Syndrome resulting from ectopic ACTH expression, e.g., in small cell lung cancer, non-small cell lung cancer (NSCLC), pancreatic carcinoma, neural tumors, or thymoma), cardiac conditions, cardiac fibrosis, cardiovascular disorders, chronic renal failure, chronic stress syndrome, cognitive dysfunction, congestive heart failure, Conn's syndrome, coronary heart diseases, Cushing's Disease, Cushing's Syndrome, depression, diabetes, endothelial dysfunction, exercise intolerance, familial hyperaldosteronism, fibrosis, galactorrhea, heart failure, hyperaldosteronism, hypercortisolemia, hypertension, hyperinsulinemia, hypokalemia, impaired cardiac function, increased formation of collagen, inflammation, metabolic syndrome, muscle atrophy, conditions associated with muscle atrophy, myocardiac fibrosis, nephropathy, obesity, post-myocardial infarction, primary hyperaldosteronism, remodeling following hypertension, renal failure, restenosis, secondary hyperaldosteronism, sleep apnea, stress related conditions, or syndrome X, or a condition that may co-present with one or more of said conditions, such as hypercholesterolemia. Said additional agent or agents may include without limitation thereto one or more of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), anti-arrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, cholesteryl ester transfer protein (CETP) inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), or Zestril (lisinopril). Further exemplary active agents include one or more corticosteroids, including glucocorticoids and/or mineralocorticoids (including agents having one or both of glucocorticoid and/or mineralocorticoid activity), such as cortisol (hydrocortisone), cortisone, prednisone, prednisolone, methylprednisolone, dexamethasone, betamethasone, triamcinolone, beclometasone, fludrocortisone (e.g., fludrocortisone acetate), deoxycorticosterone (e.g., deoxycorticosterone acetate (DOCA)), and/or aldosterone.

The present invention further contemplates an isolated nucleic acid sequence or nucleic acid sequences encoding an anti-human ACTH antibody or antibody fragment described herein as well as a vector or vectors containing these isolated nucleic acid sequence or sequences. Additionally, the invention provides a host cell comprising these isolated nucleic acid sequence or sequences or the vector or set forth above. The host cell may be a mammalian, bacterial, fungal, yeast, avian or insect cell. Preferably, the host cell is a filamentous fungi or a yeast. More preferably, the yeast is selected from the from the following genera: *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis*; and *Zygosaccharomyces. More preferably, the yeast species is of the genus Pichia*. Most preferably, the species of *Pichia* is selected from *Pichia pastoris, Pichia methanolica* and *Hansenula polymorpha (Pichia angusta)*.

The invention further provides a method of expressing an anti-human ACTH antibody or antibody fragment, typically a human, humanized, or chimeric antibody or antibody fragment, the method comprising culturing the host cell described herein under conditions that provide for expression of said antibody or antibody fragment. The host cell may be a polyploid yeast culture that stably expresses and secretes into the culture medium at least 10-25 mg/liter of said antibody or antibody fragment. The polyploid yeast may be made by a method that comprises: (i) introducing at least one expression vector containing one or more heterologous polynucleotides encoding said antibody operably linked to a promoter and a signal sequence into a haploid yeast cell; (ii) producing by mating or spheroplast fusion a polyploid yeast from said first and/or second haploid yeast cell; (iii) selecting polyploid yeast cells that stably express said antibody; and (iv) producing stable polyploid yeast cultures from said polyploid yeast cells that stably express said antibody into the culture medium. Preferably, the yeast species is of the genus *Pichia*.

The invention further relates to the therapeutic and diagnostic uses of anti-ACTH antibodies and antibody fragments. In one embodiment, the invention provides a method for blocking, inhibiting or neutralizing one or more biological effects associated with ACTH and/or treating any condition associated with elevated cortisol levels comprising administering to a subject in need thereof an effective amount of an anti-human adrenocorticotrophic hormone ("ACTH") antibody or antibody fragment. Also, the invention provides a method for treating or preventing a condition associated with elevated ACTH levels in a subject, comprising administering to a subject in need thereof an effective amount of an anti-human adrenocorticotrophic hormone ("ACTH") antibody or antibody fragment. Exemplary conditions include, but are not limited to, ACTH-driven hypercortisolism (Cushing's Disease and/or Cushing's Syndrome), obesity, diabetes, sleep apnea, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophies, hypertension, cognitive dysfunction, galactorrhea, metabolic syndromes, and hyperaldosteronism including primary hyperaldosteronism (such as Conn's syndrome), secondary hyperaldosteronism, familial hyperaldosteronism, and other conditions associated with ACTH described herein.

The invention further provides a method for neutralizing ACTH-induced MCR signaling, comprising administering to a subject in need thereof an effective amount of an anti-human adrenocorticotrophic hormone ("ACTH") antibody or antibody fragment. Moreover, the invention encompasses a method for inhibiting ACTH-induced cortisol, corticosterone, and/or aldosterone secretion, comprising administering to a subject in need thereof an effective amount of an anti-human adrenocorticotrophic hormone ("ACTH") antibody or antibody fragment. Furthermore, the invention contemplates a method for reducing ACTH-induced plasma cortisol, corticosterone, and/or aldosterone levels in a subject in need thereof, comprising administering to a subject in need thereof an effective amount of an anti-human adrenocorticotrophic hormone ("ACTH") antibody or antibody fragment.

In these methods, the anti-human ACTH antibody or antibody fragment preferably does not substantially interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH ($ACTH_{18-39}$).

In exemplary embodiments in these methods, the anti-human ACTH antibody or antibody fragment, preferably a human, humanized or chimerized anti-ACTH antibody or antibody fragment binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H and preferably the at least one isolated anti-human ACTH antibody or antibody fragment inhibits ACTH-induced signaling via a MCR, e.g., an MCR is selected from the group consisting of MC1R, MC2R, MC3R, MC4R and MC5R.

In exemplary embodiments the epitope(s) bound by the administered anti-human ACTH antibody or antibody fragment is identified using a binding assay that detects the binding of said anti-human ACTH antibody or antibody fragment to one or more peptides in a library of overlapping linear peptide fragments that span the full length of human ACTH.

In exemplary embodiments, the methods will use anti-human ACTH antibodies or antibody fragments contain at least 2 complementarity determining regions (CDRs) of an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

In exemplary embodiments, the antibody or fragment will retain the $V_H$ CDR3 and/or the $V_L$ CDR3 of one of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, OR Ab17.H, preferably Ab13.H.

In exemplary embodiments, the methods will use anti-ACTH antibodies or antibody fragments contain at least 3 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

In other exemplary embodiments, the methods will use anti-ACTH antibodies or antibody fragments contain at least 4 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

In other exemplary embodiments, the methods will use anti-ACTH antibodies or antibody fragments contain at least 5 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

In other exemplary embodiments, the methods will use anti-ACTH antibodies or antibody fragments contain all 6 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

In other exemplary embodiments, the methods will use anti-ACTH antibodies or antibody fragments that comprise (a) a variable heavy chain comprising a CDR1 sequence consisting of SEQ ID NO:4; a CDR2 sequence consisting of SEQ ID NO:6; and a CDR3 sequence consisting of SEQ ID NO:8; and/or a variable light chain comprising a CDR1 sequence consisting of SEQ ID NO:24; a CDR2 sequence consisting of SEQ ID NO:26; and a CDR3 sequence consisting of SEQ ID NO:28; (b) a variable heavy chain comprising an amino acid sequence with at least 80, 85, 90, 95, 96, 97, 98, or 99% sequence identity to SEQ ID NO:2; and/or a variable light chain comprising an amino acid sequence with at least 80, 85, 90, 95, 96, 97, 98, or 99% sequence identity to SEQ ID NO:22; (c) a variable heavy chain having the amino acid sequence of SEQ ID NO:2; and/or a variable light chain having the amino acid sequence of SEQ ID NO:22; or (d) a heavy chain having the amino acid sequence of SEQ ID NO: 1, and/or a light chain having the amino acid sequence of SEQ ID NO:21.

In other exemplary embodiments, the methods will use anti-ACTH antibodies or antibody fragments that comprise (a) a variable heavy chain comprising a CDR1 sequence consisting of SEQ ID NO:44; a CDR2 sequence consisting of SEQ ID NO:46; and a CDR3 sequence consisting of SEQ ID NO:48, and/or a variable light chain comprising a CDR1 sequence consisting of SEQ ID NO:64; a CDR2 sequence consisting of SEQ ID NO:66; and a CDR3 sequence consisting of SEQ ID NO:68; (b) a variable heavy chain comprising an amino acid sequence with at least 80, 85, 90, 95, 96, 97, 98, or 99% sequence identity to SEQ ID NO:42, and/or a variable light chain comprising an amino acid sequence with at least 80, 85, 90, 95, 96, 97, 98, or 99% sequence identity to SEQ ID NO:62; (c) a variable heavy chain having the amino acid sequence of SEQ ID NO:42, and/or a variable light chain having the amino acid sequence of SEQ ID NO:62; or (d) a heavy chain having the amino acid sequence of SEQ ID NO:41, and/or a light chain having the amino acid sequence of SEQ ID NO:61.

In other exemplary embodiments, the methods will use anti-ACTH antibodies or antibody that comprise (a) a variable heavy chain comprising a CDR1 sequence consisting of SEQ ID NO:84; a CDR2 sequence consisting of SEQ ID NO:86; and a CDR3 sequence consisting of SEQ ID NO:88, and/or a variable light chain comprising a CDR1 sequence consisting of SEQ ID NO: 104; a CDR2 sequence consisting of SEQ ID NO: 106; and a CDR3 sequence consisting of SEQ ID NO: 108; (b) a variable heavy chain comprising an amino acid sequence with at least 80, 85, 90, 95, 96, 97, 98, or 99% sequence identity to SEQ ID NO:82, and/or a variable light chain comprising an amino acid sequence with at least 80, 85, 90, 95, 96, 97, 98, or 99% sequence identity to SEQ ID NO: 102; (c) a variable heavy chain having the amino acid sequence of SEQ ID NO:82, and/or a variable light chain having the amino acid sequence of SEQ ID NO:102; or (d) a heavy chain having the amino acid sequence of SEQ ID NO:81, and/or a light chain having the amino acid sequence of SEQ ID NO:101.

In other exemplary embodiments, the methods will use anti-ACTH antibodies or antibody fragments that comprise (a) a variable heavy chain comprising a CDR1 sequence consisting of SEQ ID NO: 124; a CDR2 sequence consisting of SEQ ID NO: 126 and a CDR3 sequence consisting of SEQ ID NO: 128, and/or a variable light chain comprising a CDR1 sequence consisting of SEQ ID NO: 144; a CDR2 sequence consisting of SEQ ID NO: 146; and a CDR3 sequence consisting of SEQ ID NO: 148; (b) a variable heavy chain comprising an amino acid sequence with at least 80, 85, 90, 95, 96, 97, 98, or 99% sequence identity to SEQ ID NO: 122 and/or a variable light chain comprising an amino acid sequence with at least 80, 85, 90, 95, 96, 97, 98, or 99% sequence identity to SEQ ID NO: 142; (c) a variable heavy chain having the amino acid sequence of SEQ ID NO: 122, and/or a variable light chain having the amino acid sequence of SEQ ID NO: 142; or (d) a heavy chain having the amino acid sequence of SEQ ID NO: 121, and/or a light chain having the amino acid sequence of SEQ ID NO: 141.

In other exemplary embodiments, the methods will use anti-ACTH antibodies or antibody fragments that comprise (a) a variable heavy chain comprising a CDR1 sequence consisting of SEQ ID NO: 164; a CDR2 sequence consisting of SEQ ID NO: 166; and a CDR3 sequence consisting of SEQ ID NO: 168, and/or a variable light chain comprising a CDR1 sequence consisting of SEQ ID NO: 184; a CDR2 sequence consisting of SEQ ID NO: 186; and a CDR3 sequence consisting of SEQ ID NO: 188; (b) a variable heavy chain comprising an amino acid sequence with at least 80, 85, 90, 95, 96, 97, 98, or 99% sequence identity to SEQ ID NO: 162, and/or a variable light chain comprising an amino acid sequence with at least 80, 85, 90, 95, 96, 97, 98, or 99% sequence identity to SEQ ID NO: 182; (c) a variable heavy chain having the amino acid sequence of SEQ ID NO: 162, and/or a variable light chain having the amino acid sequence of SEQ ID NO:182; or (d) a heavy chain having the amino acid sequence of SEQ ID NO:161, and/or a light chain having the amino acid sequence of SEQ ID NO:181.

In other exemplary embodiments, the methods will use anti-ACTH antibodies or antibody fragments that comprise (a) a variable heavy chain comprising a CDR1 sequence consisting of SEQ ID NO:204; a CDR2 sequence consisting of SEQ ID NO:206; and a CDR3 sequence consisting of SEQ ID NO:208, and/or a variable light chain comprising a CDR1 sequence consisting of SEQ ID NO:224; a CDR2 sequence consisting of SEQ ID NO:226; and a CDR3 sequence consisting of SEQ ID NO:228; (b) a variable heavy chain comprising an amino acid sequence with at least 80, 85, 90, 95, 96, 97, 98, or 99% sequence identity to SEQ ID NO:202 and/or a variable light chain comprising an amino acid sequence with at least 80, 85, 90, 95, 96, 97, 98, or 99% sequence identity to SEQ ID NO:222; (c) a variable heavy chain having the amino acid sequence of SEQ ID NO:202, and/or a variable light chain having the amino acid sequence of SEQ ID NO:222; or (d) a heavy chain having the amino acid sequence of SEQ ID NO:201, and/or a light chain having the amino acid sequence of SEQ ID NO:221.

In other exemplary embodiments, the methods will use anti-ACTH antibodies or antibody fragments that comprise (a) a variable heavy chain comprising a CDR1 sequence consisting of SEQ ID NO:244; a CDR2 sequence consisting of SEQ ID NO:246; and a CDR3 sequence consisting of SEQ ID NO:248, and/or a variable light chain comprising a CDR1 sequence consisting of SEQ ID NO:264; a CDR2 sequence consisting of SEQ ID NO:266; and a CDR3 sequence consisting of SEQ ID NO:268; (b) a variable heavy chain comprising an amino acid sequence with at least 80, 85, 90, 95, 96, 97, 98, or 99% sequence identity to SEQ ID NO:242, and/or a variable light chain comprising an amino acid sequence with at least 80, 85, 90, 95, 96, 97, 98, or 99% sequence identity to SEQ ID NO:262; (c) a variable heavy chain having the amino acid sequence of SEQ ID NO:242, and/or a variable light chain having the amino acid sequence of SEQ ID NO:262; (d) a heavy chain having the amino acid sequence of SEQ ID NO:241, and/or a light chain having the amino acid sequence of SEQ ID NO:261.

In other exemplary embodiments, the methods will use anti-ACTH antibodies or antibody fragments that comprise (a) a variable heavy chain comprising a CDR1 sequence consisting of SEQ ID NO:284; a CDR2 sequence consisting of SEQ ID NO:286; and a CDR3 sequence consisting of SEQ ID NO:288, and/or a variable light chain comprising a CDR1 sequence consisting of SEQ ID NO:304; a CDR2 sequence consisting of SEQ ID NO:306; and a CDR3 sequence consisting of SEQ ID NO:308; (b) a variable heavy chain comprising an amino acid sequence with at least 80, 85, 90, 95, 96, 97, 98, or 99% sequence identity to SEQ ID NO:282, and/or a variable light chain comprising an amino acid sequence with at least 80, 85, 90, 95, 96, 97, 98, or 99% sequence identity to SEQ ID NO:302; (c) a variable heavy chain having the amino acid sequence of SEQ ID NO:282, and/or a variable light chain having the amino acid sequence of SEQ ID NO:302; (d) a heavy chain having the amino acid sequence of SEQ ID NO:281, and/or a light chain having the amino acid sequence of SEQ ID NO:301.

In other exemplary embodiments, the methods will use anti-ACTH antibodies or antibody fragments that comprise (a) a variable heavy chain comprising a CDR1 sequence consisting of SEQ ID NO:324; a CDR2 sequence consisting of SEQ ID NO:326; and a CDR3 sequence consisting of SEQ ID NO:328, and/or a variable light chain comprising a CDR1 sequence consisting of SEQ ID NO:344; a CDR2 sequence consisting of SEQ ID NO:346; and a CDR3 sequence consisting of SEQ ID NO:348; (b) a variable heavy chain comprising an amino acid sequence with at least 80, 85, 90, 95, 96, 97, 98, or 99% sequence identity to SEQ ID NO:322, and/or a variable light chain comprising an amino acid sequence with at least 80, 85, 90, 95, 96, 97, 98, or 99% sequence identity to SEQ ID NO:342; (c) a variable heavy chain having the amino acid sequence of SEQ ID NO:322, and/or a variable light chain having the amino acid sequence of SEQ ID NO:342; (d) a heavy chain having the amino acid sequence of SEQ ID NO:321, and/or a light chain having the amino acid sequence of SEQ ID NO:341.

In other exemplary embodiments, the methods will use anti-ACTH antibodies or antibody fragments that comprise (a) a variable heavy chain comprising a CDR1 sequence consisting of SEQ ID NO:364; a CDR2 sequence consisting of SEQ ID NO:366; and a CDR3 sequence consisting of SEQ ID NO:368, and/or a variable light chain comprising a CDR1 sequence consisting of SEQ ID NO:384; a CDR2 sequence consisting of SEQ ID NO:386; and a CDR3 sequence consisting of SEQ ID NO:388; (b) a variable heavy chain comprising an amino acid sequence with at least 80, 85, 90, 95, 96, 97, 98, or 99% sequence identity to SEQ ID NO:362, and/or a variable light chain comprising an amino acid sequence with at least 80, 85, 90, 95, 96, 97, 98, or 99% sequence identity to SEQ ID NO:382; (c) a variable heavy chain having the amino acid sequence of SEQ ID NO:362, and/or a variable light chain having the amino acid sequence of SEQ ID NO:382; (d) a heavy chain having the amino acid sequence of SEQ ID NO:361, and/or a light chain having the amino acid sequence of SEQ ID NO:381.

In other exemplary embodiments, the methods will use anti-ACTH antibodies or antibody fragments that comprise (a) a variable heavy chain comprising a CDR1 sequence consisting of SEQ ID NO:404; a CDR2 sequence consisting of SEQ ID NO:406; and a CDR3 sequence consisting of SEQ ID NO:408, and/or a variable light chain comprising a CDR1 sequence consisting of SEQ ID NO:424; a CDR2 sequence consisting of SEQ ID NO:426; and a CDR3 sequence consisting of SEQ ID NO:428; (b) a variable heavy chain comprising an amino acid sequence with at least 80, 85, 90, 95, 96, 97, 98, or 99% sequence identity to SEQ ID NO:402, and/or a variable light chain comprising an amino acid sequence with at least 80, 85, 90, 95, 96, 97, 98, or 99% sequence identity to SEQ ID NO:422; (c) a variable heavy chain having the amino acid sequence of SEQ ID NO:402, and/or a variable light chain having the amino acid sequence of SEQ ID NO:422; (d) a heavy chain having the amino acid sequence of SEQ ID NO:401, and/or a light chain having the amino acid sequence of SEQ ID NO:421.

In other exemplary embodiments, the methods will use anti-ACTH antibodies or antibody fragments that comprise (a) a variable heavy chain comprising a CDR1 sequence consisting of SEQ ID NO:444; a CDR2 sequence consisting of SEQ ID NO:446; and a CDR3 sequence consisting of SEQ ID NO:448, and/or a variable light chain comprising a CDR1 sequence consisting of SEQ ID NO:464; a CDR2 sequence consisting of SEQ ID NO:466; and a CDR3 sequence consisting of SEQ ID NO:468; (b) a variable heavy chain comprising an amino acid sequence with at least 80, 85, 90, 95, 96, 97, 98, or 99% sequence identity to SEQ ID NO:442, and/or a variable light chain comprising an amino acid sequence with at least 80, 85, 90, 95, 96, 97, 98, or 99% sequence identity to SEQ ID NO:462; (c) a variable heavy chain having the amino acid sequence of SEQ ID NO:442, and/or a variable light chain having the amino acid sequence of SEQ ID NO:462; (d) a heavy chain having the amino acid sequence of SEQ ID NO:441, and/or a light chain having the amino acid sequence of SEQ ID NO:461.

In other exemplary embodiments, the methods will use anti-ACTH antibodies or antibody fragments that comprise (a) a variable heavy chain comprising a CDR1 sequence consisting of SEQ ID NO:484; a CDR2 sequence consisting of SEQ ID NO:486; and a CDR3 sequence consisting of SEQ ID NO:488, and/or a variable light chain comprising a CDR1 sequence consisting of SEQ ID NO:504; a CDR2 sequence consisting of SEQ ID NO:506; and a CDR3 sequence consisting of SEQ ID NO:508; (b) a variable heavy chain comprising an amino acid sequence with at least 80, 85, 90, 95, 96, 97, 98, or 99% sequence identity to SEQ ID NO:482, and/or a variable light chain comprising an amino acid sequence with at least 80, 85, 90, 95, 96, 97, 98, or 99% sequence identity to SEQ ID NO:502; (c) a variable heavy chain having the amino acid sequence of SEQ ID NO:482, and/or a variable light chain having the amino acid sequence of SEQ ID NO:502; (d) a heavy chain having the amino acid sequence of SEQ ID NO:481, and/or a light chain having the amino acid sequence of SEQ ID NO:501.

In other exemplary embodiments, the methods will use anti-ACTH antibodies or antibody fragments that comprise (a) a variable heavy chain comprising a CDR1 sequence consisting of SEQ ID NO:524; a CDR2 sequence consisting of SEQ ID NO:526; and a CDR3 sequence consisting of SEQ ID NO:528, and/or a variable light chain comprising a CDR1 sequence consisting of SEQ ID NO:544; a CDR2 sequence consisting of SEQ ID NO:546; and a CDR3 sequence consisting of SEQ ID NO:548; (b) a variable heavy chain comprising an amino acid sequence with at least 80, 85, 90, 95, 96, 97, 98, or 99% sequence identity to SEQ ID NO:522, and/or a variable light chain comprising an amino acid sequence with at least 80, 85, 90, 95, 96, 97, 98, or 99% sequence identity to SEQ ID NO:542; (c) a variable heavy chain having the amino acid sequence of SEQ ID NO:522, and/or a variable light chain having the amino acid sequence of SEQ ID NO:542; (d) a heavy chain having the amino acid sequence of SEQ ID NO:521, and/or a light chain having the amino acid sequence of SEQ ID NO:541.

In other exemplary embodiments, the methods will use anti-ACTH antibodies or antibody fragments that comprise (a) a variable heavy chain comprising a CDR1 sequence consisting of SEQ ID NO:564; a CDR2 sequence consisting of SEQ ID NO:566; and a CDR3 sequence consisting of SEQ ID NO:568, and/or a variable light chain comprising a CDR1 sequence consisting of SEQ ID NO:584; a CDR2 sequence consisting of SEQ ID NO:586; and a CDR3 sequence consisting of SEQ ID NO:588; (b) a variable heavy chain comprising an amino acid sequence with at least 80, 85, 90, 95, 96, 97, 98, or 99% sequence identity to SEQ ID NO:562, and/or a variable light chain comprising an amino acid sequence with at least 80, 85, 90, 95, 96, 97, 98, or 99% sequence identity to SEQ ID NO:582; (c) a variable heavy chain having the amino acid sequence of SEQ ID NO:562, and/or a variable light chain having the amino acid sequence of SEQ ID NO:582; (d) a heavy chain having the amino acid sequence of SEQ ID NO:561, and/or a light chain having the amino acid sequence of SEQ ID NO:581.

In other exemplary embodiments, the methods will use anti-ACTH antibodies or antibody fragments that comprise (a) a variable heavy chain comprising a CDR1 sequence consisting of SEQ ID NO:604; a CDR2 sequence consisting of SEQ ID NO:606; and a CDR3 sequence consisting of SEQ ID NO:608, and/or a variable light chain comprising a CDR1 sequence consisting of SEQ ID NO:624; a CDR2 sequence consisting of SEQ ID NO:626; and a CDR3 sequence consisting of SEQ ID NO:628; (b) a variable heavy chain comprising an amino acid sequence with at least 80, 85, 90, 95, 96, 97, 98, or 99% sequence identity to SEQ ID NO:602, and/or a variable light chain comprising an amino acid sequence with at least 80, 85, 90, 95, 96, 97, 98, or 99% sequence identity to SEQ ID NO:622; (c) a variable heavy chain having the amino acid sequence of SEQ ID NO:602, and/or a variable light chain having the amino acid sequence of SEQ ID NO:622; (d) a heavy chain having the amino acid sequence of SEQ ID NO:601, and/or a light chain having the amino acid sequence of SEQ ID NO:621.

In other exemplary embodiments, the methods will use anti-ACTH antibodies or antibody fragments that comprise (a) a variable heavy chain comprising a CDR1 sequence consisting of SEQ ID NO:644; a CDR2 sequence consisting of SEQ ID NO:646; and a CDR3 sequence consisting of SEQ ID NO:648, and/or a variable light chain comprising a CDR1 sequence consisting of SEQ ID NO:664; a CDR2 sequence consisting of SEQ ID NO:666; and a CDR3 sequence consisting of SEQ ID NO:668; (b) a variable heavy chain comprising an amino acid sequence with at least 80, 85, 90, 95, 96, 97, 98, or 99% sequence identity to SEQ ID NO:642, and/or a variable light chain comprising an amino acid sequence with at least 80, 85, 90, 95, 96, 97, 98, or 99% sequence identity to SEQ ID NO:662; (c) a variable heavy chain having the amino acid sequence of SEQ ID NO:642, and/or a variable light chain having the amino acid sequence of SEQ ID NO:662; (d) a heavy chain having the amino acid sequence of SEQ ID NO:641, and/or a light chain having the amino acid sequence of SEQ ID NO:661.

In other exemplary embodiments, the anti-ACTH antibodies or antibody fragments used in the methods are chimeric, humanized, and human antibodies or antibody fragments.

In other exemplary embodiments, the methods will use anti-ACTH antibodies or antibody fragments selected from the group consisting of scFvs, camelbodies, nanobodies, IgNAR, Fab fragments, Fab' fragments, MetMab like antibodies, monovalent antibody fragments, and F(ab')$_2$ fragments.

In other exemplary embodiments, the methods will use anti-ACTH antibodies or antibody fragments that substantially or entirely lack N-glycosylation and/or O-glycosylation.

In other exemplary embodiments, the methods will use anti-ACTH antibodies or antibody fragments that comprise a human constant domain, e.g., an IgG1, IgG2, IgG3, or IgG4 antibody.

In other exemplary embodiments, the methods will use anti-ACTH antibodies or antibody fragments that comprise an Fc region that has been modified to alter at least one of effector function, half-life, proteolysis, or glycosylation.

In other exemplary embodiments, the methods will use anti-ACTH antibodies or antibody fragments having an Fc region which contains one or more mutations that alters or eliminates N- and/or O-glycosylation.

In other exemplary embodiments, the methods will use a human or humanized anti-ACTH antibody or antibody fragment.

In other exemplary embodiments, the methods will use anti-ACTH antibodies or antibody fragments that bind to ACTH with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M.

In other exemplary embodiments, the methods will use anti-ACTH antibodies or antibody fragments that bind to ACTH with a $K_D$ of less than or equal to $5\times10^{-10}$ M, $10^{-10}$ M, $5\times10^{-11}$ M, $10^{-11}$ M, $5\times10^{-12}$ M, or $10^{-12}$ M.

In other exemplary embodiments, the methods will use anti-ACTH antibodies or antibody fragments that bind to ACTH with an off-rate ($k_d$) of less than or equal to $5\times10^{-4}$ s$^{-1}$, $10^{-4}$ s$^{-1}$, $5\times10^{-5}$ s$^{-1}$, or $10^{-5}$ s$^{-1}$.

In other exemplary embodiments, the methods will use anti-ACTH antibodies or antibody fragments that are directly or indirectly attached to a therapeutic agent.

In other exemplary embodiments, the methods will use anti-ACTH antibodies or antibody fragments that are attached to one or more detectable moieties.

In other exemplary embodiments, the methods will use anti-ACTH antibodies or antibody fragments comprising a detectable moiety, e.g., that comprises a fluorescent dye, enzyme, substrate, bioluminescent material, radioactive material, chemiluminescent moiety, or mixtures thereof.

In other exemplary embodiments, the methods will use anti-ACTH antibodies or antibody fragments that are attached to one or more functional moieties.

In other exemplary embodiments, the methods will use anti-ACTH antibodies or antibody fragments that reduce plasma cortisol, corticosterone, and/or aldosterone levels.

In other exemplary embodiments, the methods further comprise administering separately or co-administering another agent, e.g., selected from the group consisting of ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), and satavaptan (SR121463, planned trade name Aquilda®), mifepristone (Korlym®), armodafinil (Nuvigil®) and modafinil (Provigil®). Further, said additional agent may include without limitation thereto one or more of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), or Zestril (lisinopril). Further exemplary active agents include one or more corticosteroids, including glucocorticoids and/or mineralocorticoids (including agents having one or both of glucocorticoid and/or mineralocorticoid activity), such as cortisol (hydrocortisone), cortisone, prednisone, prednisolone, methylprednisolone, dexamethasone, betamethasone, triamcinolone, beclometasone, fludrocortisone (e.g., fludrocortisone acetate), deoxycorticosterone (e.g., deoxycorticosterone acetate (DOCA)), and/or aldosterone. The antibody or antibody fragment or the composition containing the antibody of antibody fragment and the at least one other agent may be administered concurrently sequentially, e.g., the antibody or antibody fragment is administered before or after the at least one other agent.

In yet other exemplary embodiments, the methods further comprise using the anti-ACTH antibodies or antibody fragments disclosed herein in combination with supplemental oxygen, continuous positive airway pressure (CPAP), bilevel positive airway pressure (BPAP), expiratory positive airway pressure (EPAP), adaptive servo-ventilation (ASV), oral applicanes, uvulopalatopharyngoplasty (UPPP), maxilloandibular advancement, nasal surgery, and removal of tonsils and/or adenoids to treat sleep apnea.

In other exemplary methods, the anti-ACTH antibody or antibody fragment is a human, humanized or chimerized anti-ACTH antibody or antibody fragment which substantially does not interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH ($ACTH_{18-39}$) (Corticotrophin-Like Intermediate peptide or "CLIP").

In other exemplary embodiments, the anti-ACTH antibody or antibody fragment is a human, humanized or chimerized anti-ACTH antibody or antibody fragment which binds to $ACTH_{1-39}$ with a binding affinity ($K_D$) at least 10-fold, 100-fold, 1000-fold or 10,000-fold stronger than the binding affinity of said antibody or antibody fragment to (i) $ACTH_{1-13}$ and/or alpha-MSH, and/or (ii) CLIP (i.e., a numerically lower $K_D$ for $ACTH_{1-39}$ by at least 10-fold, 100-fold, 1000-fold or 10,000-fold relative to the $K_D$ for $ACTH_{1-13}$ and/or alpha-MSH and/or CLIP).

In other exemplary embodiments, the anti-ACTH antibody or antibody fragment is a human, humanized or chimerized anti-human ACTH antibody or antibody fragment which neutralizes or inhibits ACTH activation of MC2R.

In other exemplary embodiments, the anti-ACTH antibody or antibody fragment is a human, humanized or chimerized anti-human ACTH antibody or antibody fragment which neutralizes or inhibits ACTH activation of at least one of MC2R, MC3R and MC4R.

In other exemplary embodiments, the anti-ACTH antibody or antibody fragment is a human, humanized or chimerized anti-human ACTH antibody or antibody fragment, which neutralizes or inhibits ACTH activation of each of MC2R, MC3R and MC4R.

In other exemplary embodiments, the anti-ACTH antibody or antibody fragment is a human, humanized or chimerized anti-human ACTH antibody or antibody fragment, which inhibits ACTH-induced corticosterone secretion.

In other exemplary embodiments, the anti-ACTH antibody or antibody fragment is a human, humanized or chimerized anti-human ACTH antibody or antibody fragment, which when administered to a human subject reduces plasma cortisol, corticosterone and/or aldosterone levels.

In other exemplary embodiments, the anti-ACTH antibody or antibody fragment is a human, humanized or chimerized anti-human ACTH antibody or antibody fragment capable of inhibiting the binding of ACTH to a MCR.

In other exemplary embodiments, the anti-ACTH antibody or antibody fragment is a human, humanized or chimerized anti-human ACTH antibody or antibody fragment, capable of inhibiting the binding of ACTH to at least one of MC1R, MC2R, MC3R, MC4R and MC5R; at least one of MC2R, MC3R, and MC4R; each of MC2R, MC3R, and MC4R; or each of MC1R, MC2R, MC3R, MC4R and MC5R.

BRIEF DESCRIPTION OF THE DRAWINGS

FIG. 1A-1G provides the polypeptide sequences of the full-length heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H (SEQ ID NOs: 1; 41; 81; 121; 161; 201; 241; 281; 321; 361; 401; 441; 481; 521; 561; 601; 641 respectively) aligned by their framework regions (FR) and complementarity determining regions (CDRs), and constant regions.

FIG. 2A-2D provide the polypeptide sequences of the full-length light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H (SEQ ID NOs: 21; 61; 101; 141; 181; 221; 261; 301; 341; 381; 421; 461; 501; 541; 581; 621; and 661, respectively) aligned by their framework regions (FR), complementarity determining regions (CDRs), and constant regions.

FIG. 3A-3S provide the polynucleotide sequences encoding the full-length heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H (SEQ ID NOs: 11; 51; 91; 131; 171; 211; 251; 291; 331; 371; 411; 451; 491; 531; 571; 611; and 651, respectively) aligned by their framework regions (FR), complementarity determining regions (CDRs), and constant regions.

FIG. 4A-I provide the polynucleotide sequences encoding the full-length light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H (SEQ ID NOs: 31; 71; 111; 151; 191; 231; 271; 311; 351; 391; 431; 471; 511; 551; 591; 631; and 671 respectively) aligned by their framework regions (FR), complementarity determining regions (CDRs), and constant regions.

FIG. 5A provides the polypeptide sequence coordinates for certain antibody heavy chain protein sequence features including the variable region and complementarity determining regions (CDRs) of the heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 5B provides the polypeptide sequence coordinates for certain antibody heavy chain protein sequence features including the variable region and complementarity determining regions (CDRs) of the heavy chain for antibodies Ab1-Ab7 and Ab9-Ab12.

FIG. 6A provides the polypeptide sequence coordinates for certain antibody heavy chain protein sequence features including the constant region and framework regions (FR) of the heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 6B provides the polypeptide sequence coordinates for certain antibody heavy chain protein sequence features including the constant region and framework regions (FR) of the heavy chain for antibodies Ab1-Ab7 and Ab9-Ab12.

FIG. 7A provides the polypeptide sequence coordinates for certain antibody light chain protein sequence features including the variable region and complementarity determining regions (CDRs) of the light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 7B provides the polypeptide sequence coordinates for certain antibody light chain protein sequence features including the variable region and complementarity determining regions (CDRs) of the light chain for antibodies Ab1-Ab7 and Ab9-Ab12.

FIG. 8A provides the polypeptide sequence coordinates for certain antibody light chain protein sequence features including the constant region and framework regions (FR) of the light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 8B provides the polypeptide sequence coordinates for certain antibody light chain protein sequence features including the constant region and framework regions (FR) of the light chain for antibodies Ab1-Ab7 and Ab9-Ab12.

FIG. 9A provides the polynucleotide sequence coordinates for certain antibody heavy chain DNA sequence features including the variable region and complementarity determining regions (CDRs) of the heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 9B provides the polynucleotide sequence coordinates for certain antibody heavy chain DNA sequence features including the variable region and complementarity determining regions (CDRs) of the heavy chain for antibodies Ab1-Ab7 and Ab9-Ab12.

FIG. 10A provides the polynucleotide sequence coordinates for certain antibody heavy chain DNA sequence features including the constant region and framework regions (FR) of the heavy chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 10B provides the polynucleotide sequence coordinates for certain antibody heavy chain DNA sequence features including the constant region and framework regions (FR) of the heavy chain for antibodies Ab1-Ab7 and Ab9-Ab12.

FIG. 11A provides the polynucleotide sequence coordinates for certain antibody light chain DNA sequence features including the variable region and complementarity determining regions (CDRs) of the light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 11B provides the polynucleotide sequence coordinates for certain antibody light chain DNA sequence features including the variable region and complementarity determining regions (CDRs) of the light chain for antibodies Ab1-Ab7 and Ab9-Ab12.

FIG. 12A provides the polynucleotide sequence coordinates for certain antibody light chain DNA sequence features including the constant region and framework regions (FR) of the light chain for antibodies Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

FIG. 12B provides the polynucleotide sequence coordinates for certain antibody light chain DNA sequence features including the constant region and framework regions (FR) of the light chain for antibodies Ab1-Ab7 and Ab9-Ab12.

FIG. 13 provides representative binding data for the subject anti-human ACTH antibodies to human ACTH (specifically, for Ab1).

FIG. 14 provides representative binding data for the subject anti-human ACTH antibodies to human ACTH1-13 and ACTH 18-39 (specifically, for Ab1).

FIG. 15 provides representative binding data for the subject anti-human ACTH antibodies to ACTH 1-39 and the inability of human ACTH 1-13 and ACTH 18-39 to compete with binding of ACTH 1-39 (specifically, for Ab5).

FIG. 16 provides representative data showing that the subject anti-ACTH antibodies (in this figure, Ab1) inhibited ACTH-induced cAMP production in cells expressing MC2R.

FIG. 17 provides representative data showing that the subject anti-ACTH antibodies (in this figure, Ab5) inhibited ACTH-induced cAMP production in cells expressing MC2R.

FIG. 18 provides representative data showing that the subject anti-ACTH antibodies (in this figure, Ab1) inhibited ACTH-induced cAMP production in cells expressing MC1R.

FIG. 19 provides representative data showing that the subject anti-ACTH antibodies (in this figure, Ab1) inhibited ACTH-induced cAMP production in cells expressing MC3R.

FIG. 20 provides representative data showing that the subject anti-ACTH antibodies (in this figure, Ab1) inhibited ACTH-induced cAMP production in cells expressing MC4R.

FIG. 21 provides representative data showing that the subject anti-ACTH antibodies (in this figure, Ab1) inhibited ACTH-induced cAMP production in cells expressing MC5R.

FIG. 22 provides representative data showing that the subject anti-ACTH antibodies (in this figure, Ab1) inhibited ACTH-induced cortisol production by Y1 cells.

FIG. 23 shows plasma corticosterone levels pre-dose of Ab2 or Ab3 for the experiments described in Example 6.

FIG. 24 shows plasma corticosterone levels 48 hours after the first dose of Ab2, Ab3, or vehicle control (AD26-10) antibody for the experiments described in Example 6.

FIG. 25 shows plasma corticosterone levels 48 hours after the second dose of Ab2, Ab3, or vehicle control (AD26-10) antibody for the experiments described in Example 6.

FIG. 26 shows plasma corticosterone levels 120 hours after the second dose of Ab2, Ab3, or vehicle control (AD26-10) antibody for the experiments described in Example 6.

FIG. 27 shows the percent change in animal weight for animals treated with Ab6 and dosed with ACTH using an infusion pump for the experiments described in Example 7. ANOVA analysis was performed at day 8 to compare Vehicle/control antibody (AD26-10) to ACTH/control antibody (AD26-10) which showed a significant difference (p<0.0001), and to compare ACTH/Ab6 to ACTH/AD26-10 which also showed a significant difference (p<0.0001).

FIG. 28 shows plasma corticosterone levels before initiation of ACTH dosing and antibody administration for the experiments described in Example 7.

FIG. 29 shows plasma corticosterone levels 24 hours post initiation of ACTH dosing and pre-Ab dose for the experiments described in Example 7.

FIG. 30 shows plasma corticosterone levels 48 hours post initiation of ACTH dosing and 24 hours post Ab dose (Ab6) for the experiments described in Example 7.

FIG. 31 shows plasma corticosterone levels 96 hours post initiation of ACTH dosing and 72 hours post Ab dose (Ab6) for the experiments described in Example 7.

FIG. 32 shows plasma corticosterone levels 144 hours post initiation of ACTH dosing and 120 hours post Ab dose (Ab6) for the experiments described in Example 7.

FIG. 33 shows plasma corticosterone levels 168 hours post initiation of ACTH dosing and 144 hours post Ab dose (Ab6) for the experiments described in Example 7.

FIG. 34 shows plasma aldosterone levels before the initiation of ACTH dosing and antibody administration for the experiments described in Example 7.

FIG. 35 shows plasma aldosterone levels 24 hours post initiation of ACTH dosing and pre-Ab dose for the experiments described in Example 7.

FIG. 36 shows plasma aldosterone levels 48 hours post initiation of ACTH dosing and 24 hours post Ab dose (Ab6) for the experiments described in Example 7.

FIG. 37 shows plasma aldosterone levels 96 hours post initiation of ACTH dosing and 72 hours post Ab dose (Ab6) for the experiments described in Example 7.

FIG. 38 shows plasma aldosterone levels 144 hours post initiation of ACTH dosing and 120 hours post Ab dose (Ab6) for the experiments described in Example 7.

FIG. 39 shows plasma aldosterone levels 168 hours post initiation of ACTH dosing and 144 hours post Ab dose (Ab6) for the experiments described in Example 7.

FIG. 40A-O shows results of binding kinetics measurements for binding of anti-ACTH antibodies to alanine scanning mutants of human ACTH. Each upper panel shows results for wild-type huACTH and alanine scanning mutants that were determined to substantially affect binding, indicating that these positions formed part of the epitope bound by this antibody. Each lower panel shows traces for all of the remaining alanine scanning mutants (along with wild-type huACTH shown for reference).

FIG. 41 shows the results of alanine scanning mutagenesis used to identify positions in ACTH that form the epitope bound by each tested antibody. In the column under each antibody name are listed the mutation of which substantially altered the binding kinetics of the antibody to ACTH, which was interpreted to indicate that the position forms part of the epitope bound by that antibody. For visual illustration the positions are listed in order of their position, e.g., the seventh row below the header is labeled "7A" for those antibodies for which the 7A mutant resulted in substantially decreased binding to ACTH. An empty cell indicates a mutant position that did not substantially alter binding kinetics for that antibody. The rows corresponding to positions 24 and beyond are not shown because none of these positions was observed to substantially alter antibody binding kinetics.

FIG. 42 shows the results of $^{125}$I ACTH binding experiments demonstrating that the tested anti-ACTH antibodies inhibited the binding of ACTH to MC2R expressing cells, as further described in Example 9. Each antibody tested is labeled on the X-axis and the level of binding detected is shown on the Y-axis.

FIG. 43 is a representative binding curve that shows neutralization of ACTH 1-24 induced signaling via MC2R (in this case, by Ab2).

FIG. 44 is a representative binding curve that shows neutralization of ACTH 1-24 induced signaling via MC2R (in this figure, by Ab13.H).

FIG. 45 provides representative binding data for the subject anti-human ACTH antibodies to ACTH 1-39 and the inability of human ACTH 1-13 and ACTH 18-39 to compete with binding of ACTH 1-39 (specifically, for Ab13).

FIG. 46 provides representative data showing the inhibition of ACTH driven cAMP production in MC2R expressing cells (in this figure, by Ab13.)

FIG. 47 provides representative data showing the inhibition of ACTH driven cAMP production in MC1R expressing cells (in this figure, by Ab13.)

FIG. 48 provides representative data showing the inhibition of ACTH driven cAMP production in MC3R expressing cells (in this figure, by Ab13.)

FIG. 49 provides representative data showing the inhibition of ACTH driven cAMP production in MC4R expressing cells (in this figure, by Ab13.)

FIG. 50 provides representative data showing the inhibition of ACTH driven cAMP production in MC5R expressing cells (in this figure, by Ab13.)

FIG. 51 provides representative data showing that the subject anti-ACTH antibodies (in this figure, Ab13.H) inhibited ACTH-induced cortisol production by Y1 cells.

FIG. 52 shows that Ab1.H inhibited ACTH-induced weight loss in the study described in Example 13.

FIG. 53 shows plasma corticosterone levels before ACTH and antibody dosing in the study described in Example 13.

FIG. 54 shows plasma corticosterone levels at 24 hours after initiation of ACTH dosing and before the antibody administration in the study described in Example 13.

FIG. 55 shows plasma corticosterone levels 48 hours after initiation of ACTH dosing and 24 hours after the antibody administration in the study described in Example 13.

FIG. 56 shows plasma corticosterone levels 96 hours after initiation of ACTH dosing and 72 hours after the antibody administration in the study described in Example 13.

FIG. 57 shows plasma corticosterone levels 144 hours after initiation of ACTH dosing and 120 hours after the antibody administration in the study described in Example 13.

FIG. 58 shows plasma corticosterone levels 168 hours after initiation of ACTH dosing and 144 hours after the antibody administration in the study described in Example 13.

FIG. 59 shows plasma aldosterone levels before ACTH and antibody dosing in the study described in Example 13.

FIG. 60 shows plasma aldosterone levels at 24 hours after initiation of ACTH dosing and before the antibody administration in the study described in Example 13.

FIG. 61 shows plasma aldosterone levels 48 hours after initiation of ACTH dosing and 24 hours after the antibody administration in the study described in Example 13.

FIG. 62 shows plasma aldosterone levels 96 hours after initiation of ACTH dosing and 72 hours after the antibody administration in the study described in Example 13.

FIG. 63 shows plasma aldosterone levels 144 hours after initiation of ACTH dosing and 120 hours after the antibody administration in the study described in Example 13.

FIG. 64 shows plasma aldosterone levels 168 hours after initiation of ACTH dosing and 144 hours after the antibody administration in the study described in Example 13.

FIG. 65 shows the percentage change in animal weight by day, and shows that Ab2.H, Ab11.H, and Ab12.H inhibited ACTH-induced weight loss for the study described in Example 14.

FIG. 66 shows plasma corticosterone levels before ACTH and antibody dosing for animals treated with Ab2.H, Ab11.H, and Ab12.H as described in Example 14.

FIG. 67 shows plasma corticosterone levels at 24 hours after initiation of ACTH dosing and before the antibody administration for animals treated with Ab2.H, Ab11.H, and Ab12.H as described in Example 14.

FIG. 68 shows plasma corticosterone levels 48 hours after initiation of ACTH dosing and 24 hours after the antibody administration for animals treated with Ab2.H, Ab11.H, and Ab12.H as described in Example 14.

FIG. 69 shows plasma corticosterone levels 96 hours after initiation of ACTH dosing and 72 hours after the antibody administration for animals treated with Ab2.H, Ab11.H, and Ab12.H as described in Example 14.

FIG. 70 shows plasma corticosterone levels 144 hours after initiation of ACTH dosing and 120 hours after the antibody administration for animals treated with Ab2.H, Ab11.H, and Ab12.H as described in Example 14.

FIG. 71 shows plasma aldosterone levels before ACTH and antibody dosing for animals treated with Ab2.H, Ab11.H, and Ab12.H as described in Example 14.

FIG. 72 shows plasma aldosterone levels at 24 hours after initiation of ACTH dosing and before the antibody administration for animals treated with Ab2.H, Ab11.H, and Ab12.H as described in Example 14.

FIG. 73 shows plasma aldosterone levels 48 hours after initiation of ACTH dosing and 24 hours after the antibody administration for animals treated with Ab2.H, Ab11.H, and Ab12.H as described in Example 14.

FIG. 74 shows plasma aldosterone levels 96 hours after initiation of ACTH dosing and 72 hours after the antibody administration for animals treated with Ab2.H, Ab11.H, and Ab12.H as described in Example 14.

FIG. 75 shows plasma aldosterone levels 144 hours after initiation of ACTH dosing and 120 hours after the antibody administration for animals treated with Ab2.H, Ab11.H, and Ab12.H as described in Example 14.

FIG. 76 shows the percentage change in animal weight by day, and shows that Ab10.H inhibited ACTH-induced weight loss in the study described in Example 14.

FIG. 77 shows plasma corticosterone levels before ACTH and antibody dosing for animals treated with Ab10.H as described in Example 14.

FIG. 78 shows plasma corticosterone levels at 24 hours after initiation of ACTH dosing and before the antibody administration for animals treated with Ab10.H as described in Example 14.

FIG. 79 shows plasma corticosterone levels 48 hours after initiation of ACTH dosing and 24 hours after the antibody administration for animals treated with Ab10.H as described in Example 14.

FIG. 80 shows plasma corticosterone levels 96 hours after initiation of ACTH dosing and 72 hours after the antibody administration for animals treated with Ab10.H as described in Example 14.

FIG. 81 shows plasma corticosterone levels 144 hours after initiation of ACTH dosing and 120 hours after the antibody administration for animals treated with Ab10.H as described in Example 14.

FIG. 82 shows plasma aldosterone levels before ACTH and antibody dosing for animals treated with Ab10.H as described in Example 14.

FIG. 83 shows plasma aldosterone levels at 24 hours after initiation of ACTH dosing and before the antibody administration for animals treated with Ab10.H as described in Example 14.

FIG. 84 shows plasma aldosterone levels 48 hours after initiation of ACTH dosing and 24 hours after the antibody administration for animals treated with Ab10.H as described in Example 14.

FIG. 85 shows plasma aldosterone levels 96 hours after initiation of ACTH dosing and 72 hours after the antibody administration for animals treated with Ab10.H as described in Example 14.

FIG. 86 shows plasma aldosterone levels 144 hours after initiation of ACTH dosing and 120 hours after the antibody administration for animals treated with Ab10.H as described in Example 14.

FIG. 87 shows the percentage change in animal weight by day, and shows that Ab13.H inhibited ACTH-induced weight loss for the study described in Example 14.

FIG. 88 shows plasma corticosterone levels before ACTH and antibody dosing for animals treated with Ab13.H as described in Example 14.

FIG. 89 shows plasma corticosterone levels at 24 hours after initiation of ACTH dosing and before the antibody administration for animals treated with Ab13.H as described in Example 14.

FIG. 90 shows plasma corticosterone levels 48 hours after initiation of ACTH dosing and 24 hours after the antibody administration for animals treated with Ab13.H as described in Example 14.

FIG. 91 shows plasma corticosterone levels 96 hours after initiation of ACTH dosing and 72 hours after the antibody administration for animals treated with Ab13.H as described in Example 14.

FIG. 92 shows plasma corticosterone levels 144 hours after initiation of ACTH dosing and 120 hours after the antibody administration for animals treated with Ab13.H as described in Example 14.

FIG. 93 shows plasma aldosterone levels before ACTH and antibody dosing for animals treated with Ab13.H as described in Example 14.

FIG. 94 shows plasma aldosterone levels at 24 hours after initiation of ACTH dosing and before the antibody administration for animals treated with Ab13.H as described in Example 14.

FIG. 95 shows plasma aldosterone levels 48 hours after initiation of ACTH dosing and 24 hours after the antibody administration for animals treated with Ab13.H as described in Example 14.

FIG. 96 shows plasma aldosterone levels 96 hours after initiation of ACTH dosing and 72 hours after the antibody administration for animals treated with Ab13.H as described in Example 14.

FIG. 97 shows plasma aldosterone levels 144 hours after initiation of ACTH dosing and 120 hours after the antibody administration for animals treated with Ab13.H as described in Example 14.

FIG. 98 shows the percentage change in animal weight by day, and shows that Ab7A.H inhibited ACTH-induced weight loss for the study described in Example 14.

FIG. 99 shows plasma corticosterone levels before ACTH and antibody dosing for animals treated with Ab7A.H as described in Example 14.

FIG. 100 shows plasma corticosterone levels at 24 hours after initiation of ACTH dosing and before the antibody administration for animals treated with Ab7A.H as described in Example 14.

FIG. 101 shows plasma corticosterone levels 48 hours after initiation of ACTH dosing and 24 hours after the antibody administration for animals treated with Ab7A.H as described in Example 14.

FIG. 102 shows plasma corticosterone levels 96 hours after initiation of ACTH dosing and 72 hours after the antibody administration for animals treated with Ab7A.H as described in Example 14.

FIG. 103 shows plasma corticosterone levels 144 hours after initiation of ACTH dosing and 120 hours after the antibody administration for animals treated with Ab7A.H as described in Example 14.

FIG. 104 shows plasma aldosterone levels before ACTH and antibody dosing for animals treated with Ab7A.H as described in Example 14.

FIG. 105 shows plasma aldosterone levels at 24 hours after initiation of ACTH dosing and before the antibody administration for animals treated with Ab7A.H as described in Example 14.

FIG. 106 shows plasma aldosterone levels 48 hours after initiation of ACTH dosing and 24 hours after the antibody administration for animals treated with Ab7A.H as described in Example 14.

FIG. 107 shows plasma aldosterone levels 96 hours after initiation of ACTH dosing and 72 hours after the antibody administration for animals treated with Ab7A.H as described in Example 14.

FIG. 108 shows plasma aldosterone levels 144 hours after initiation of ACTH dosing and 120 hours after the antibody administration for animals treated with Ab7A.H as described in Example 14.

FIG. 109 shows plasma corticosterone levels before ACTH and antibody dosing for animals treated with Ab11A.H and Ab15.H as described in Example 14.

FIG. 110 shows plasma corticosterone levels at 24 hours after initiation of ACTH dosing and before the antibody administration for animals treated with Ab11A.H and Ab15.H as described in Example 14.

FIG. 111 shows plasma corticosterone levels 48 hours after initiation of ACTH dosing and 24 hours after the antibody administration for animals treated with Ab11A.H and Ab15.H as described in Example 14.

FIG. 112 shows plasma corticosterone levels 96 hours after initiation of ACTH dosing and 72 hours after the antibody administration for animals treated with Ab11A.H and Ab15.H as described in Example 14.

FIG. 113 shows total Ab13.H antibody levels determined in each rat in the pharmacokinetic study described in Example 15.

FIG. 114 shows the change in cortisol levels from baseline following injection of AD26-10 or Ab13.H over time in cynomolgus monkeys. The results demonstrate that Ab13.H reduced cortisol levels.

FIG. 115 shows the change in aldosterone levels from baseline following injection of AD26-10 or Ab13.H over time in cynomolgus monkeys. The results demonstrate that Ab13.H reduced aldosterone levels.

FIG. 116 shows the corticosterone levels observed over time in rats dosed with AD26-10 or Ab13.H.

FIG. 117 shows the total antibody levels in rats over time following administration of AD26-10 or Ab13.H.

Figure 118:
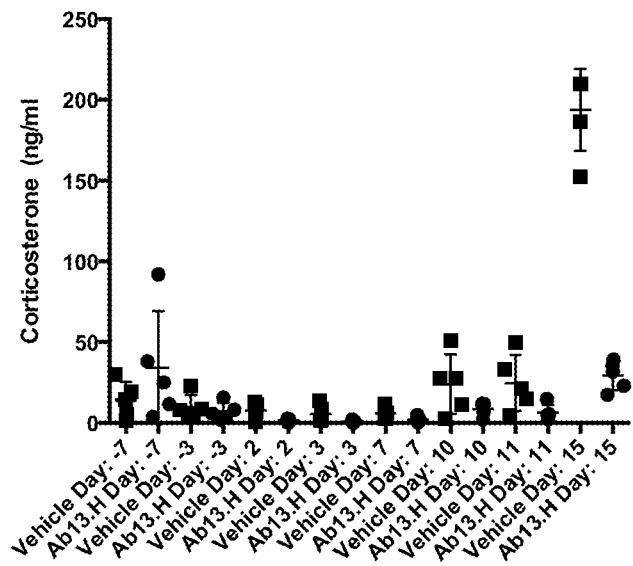

FIG. 118 shows plasma corticosterone levels in rabbits treated with vehicle (squares) or Ab13.H (circles). Corticosterone levels were reduced in the Ab13.H treatment group on days 10 and 11. Corticosterone levels were significantly lower in the Ab13.H treatment group on day 15 ($p=0.0079$) compared to control animals.

Figure 119:
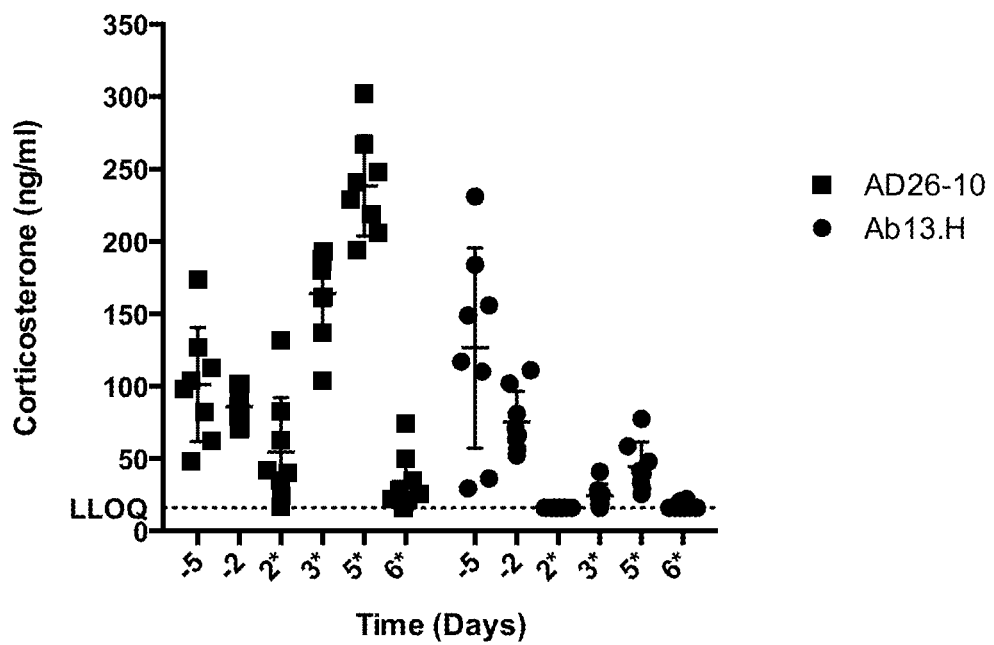

FIG. 119 shows the plasma corticosterone levels in rats treated with AD26-10 (square symbols) or Ab13.H (round symbols) and subjected to low or high stress conditions. Plasma corticosterone levels were significantly reduced on days 2, 3, and 5 (all $p=0.0002$), and day 6 ($p=0.0068$) in the Ab13.H treatment group compared to controls.

DETAILED DESCRIPTION

Antibodies and binding fragments thereof that bind to ACTH are disclosed herein. The antibody or antibody fragment according to the invention bind to ACTH and prevent ACTH from functioning in various ways. In some embodiments, the antibody or antibody fragment neutralizes ACTH-induced MCR signaling, inhibits ACTH-induced cortisol, corticosterone, and/or aldosterone secretion and/or reduces plasma cortisol, corticosterone, and/or aldosterone levels.

For convenience, the following sections generally outline the various meanings of the terms used herein. Following this discussion, general aspects regarding antibodies or antibody fragments according to the invention are discussed, followed by specific examples demonstrating the properties of various embodiments of the antibodies or antibody fragments according to the invention and how they can be employed.

Definitions

It is to be understood that this invention is not limited to the particular methodology, protocols, cell lines, animal species or genera, and reagents described, as such may vary. It is also to be understood that the terminology used herein is for the purpose of describing particular embodiments only, and is not intended to limit the scope of the present invention which will be limited only by the appended claims. As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

The terms "adrenocorticotropic hormone" or "adrenocorticotropin" or "adrenocorticotrophin" or "ACTH" or "ACTH 1-39" or "ACTH$_{1-39}$" or "corticotropin" or "corticotrophin" are used interchangeably and refer to the polypeptide as set forth in SEQ ID NO:1121 as well as related polypeptides, which include, but are not limited to, derivative variants, substitution variants, deletion variants, and/or insertion variants including the addition of an N-terminal methionine, fusion polypeptides, and interspecies homologs. The terms "human adrenocorticotropic hormone" or "human adrenocorticotropin" or "human adrenocorticotrophin" or "hACTH" or "hACTH 1-39" or "hACTH$_{1-39}$" or "huACTH" or "huACTH 1-39" or "huACTH$_{1-39}$" are used interchangeably and refer specifically to a human ACTH polypeptide such as the polypeptide as set forth in SEQ ID NO:1121. In certain embodiments, an ACTH polypeptide includes terminal residues, such as, but not limited to, leader sequence residues, targeting residues, amino terminal methionine residues, lysine residues, tag residues, and/or fusion protein residues. ACTH has also been referred to as corticotrophin or corticotropin. ACTH is a peptide hormone produced by post-translational enzymatic processing of POMC. In some tissues, e.g., the intermediate lobe, ACTH is further enzymatically processed to generate alpha-MSH and CLIP. Alpha-MSH has the same primary amino acid sequence as ACTH$_{1-13}$; however, two of the amino acids are modified in alpha-MSH, i.e., the N-terminal serine is acetylated and the C-terminal valine is amidated, but not ACTH$_{1-13}$. CLIP corresponds to ACTH$_{18-39}$.

Except where the context indicates otherwise, the term "ACTH" as used herein denotes the full-length human-ACTH peptide containing 39 amino acids (SYSMEH-FRWGKPVGKKRRPVKVYPNGAEDESAEAFPLEF, SEQ ID NO:1121). ACTH is distinct from "ACTH 1-13" (SYSMEHFRWGKPV, SEQ ID NO:1123), "ACTH 18-39" (RPVKVYPNGAEDESAEAFPLEF, SEQ ID NO: 1124) and"ACTH 1-24" (SYSMEHFRWGKPVGKKRRPVK-VYP, SEQ ID NO:1122). However, the term also refers to the ACTH of another species when indicated by context, e.g., equine ACTH or horse ACTH (*Equus* przewalskii, NCBI Accession No. XP_008513480), feline ACTH or cat ACTH (*Felis catus*, NCBI Accession No. XP_003984482), and canine ACTH or dog ACTH (*canus* lupus *familiaris*, NCBI accession no. AAK08973). The term ACTH also encompasses ACTH molecules incorporating post-translational modifications, e.g., phosphorylation, glycosylation, ubiquitination, acetylation, methylation and/or amidation.

The term "human alpha-MSH" refers to a peptide that consists of amino acids 1-13 of human ACTH. As discussed herein, alpha-MSH has the same primary amino acid sequence as amino acids 1-13 of human ACTH (also referred to as "ACTH 1-13" or "ACTH$_{1-13}$"), but two of the amino acids are modified in alpha-MSH, specifically, the N-terminal serine is acetylated and the C-terminal valine is amidated (having the sequence SYSMEHFRWGKPV where S1 is acetylated and V13 is amidated, SEQ ID NO: 1125). Except where context dictates otherwise, the terms "alpha-MSH" herein indicate human alpha-MSH.

The terms "human CLIP" or "human Corticotrophin-Like Intermediate Peptide" or "hACTH$_{18-39}$" or "hCLIP" or "ACTH 18-39" are used interchangeably and each refers to a peptide that consists of the 22 C-terminal amino acid residues of human ACTH, i.e., amino acids 18-39 of the human ACTH polypeptide of SEQ ID NO:1121 (having the sequence RPVKVYPNGAEDESAEAFPLEF, SEQ ID NO:1124). Except where context dictates otherwise, the terms "CLIP" or "Corticotrophin-Like Intermediate Peptide" herein indicate human CLIP.

The term "anti-ACTH antibody or antibody fragment that does not substantially interact with or bind to at least one of ACTH$_{1-13}$, alpha-MSH, and/or ACTH$_{18-39}$ (CLIP)" means that the anti-ACTH antibody or antibody fragment binds to ACTH, typically human ACTH, with a binding affinity ($K_D$) that is substantially stronger than the binding affinity for said anti-ACTH antibody or antibody fragment to at least one of ACTH$_{1-13}$, alpha-MSH, and/or ACTH$_{18-39}$ (CLIP), i.e., at least 10-fold, 100-fold, 1000-fold or 10,000-fold stronger binding. Binding affinity may be expressed as "$K_D$" in molar units (e.g., nM or pM), with numerically lower values indicating stronger binding. Thus, a "stronger" affinity refers to a numerically lower $K_D$ value, while a "weaker" affinity refers to a numerically higher $K_D$ value. In exemplary embodiments, said the binding affinity of said antibody for human ACTH will be at least 100-fold stronger than its binding affinity for human CLIP and human alpha-MSH.

In some instances, this includes anti-ACTH antibodies or antibody fragments thereof that do not detectably bind to ACTH$_{1-13}$, alpha-MSH, and/or ACTH$_{18-39}$ (CLIP) (e.g., several antibodies are designated as having a $K_D$ of $1\times10^{-1}$ for CLIP in Table 5 or are designated as having a $K_D$ of $1\times10^{-1}$ for alpha-MSH in Table 6, which indicates no detectable binding).

The term "cortisol" refers to a steroid hormone, more specifically a glucocorticoid, which is produced by the zona fasciculata of the adrenal cortex released in response to stress and a low level of blood glucose. The systematic (IUPAC) name of cortisol is (11β)-11,17,21-trihydroxypregn-4-ene-3,20-dione and its structure is well known in the art and is shown below:

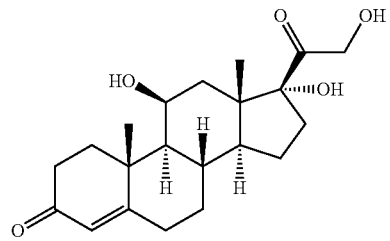

The term "Corticosterone" refers to a 21-carbon steroid hormone of the corticosteroid type produced in the cortex of the adrenal glands in rodents and other non-human animals. The systematic (IUPAC) name of corticosterone is (11β)-11,21-dihydroxypregn-4-ene-3,20-dione and its structure is well known in the art and is shown below:

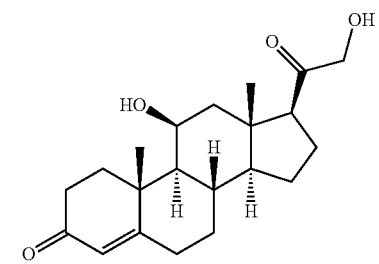

The term "aldosterone" refers is a steroid hormone of the mineralocorticoid family which is produced by the outer section (zona glomerulosa) of the adrenal cortex in the adrenal gland which plays a role in the regulation of blood pressure. The systematic (IUPAC) name of aldosterone is 11β,21-Dihydroxy-3,20-dioxopregn-4-en-18-al and its structure is well known in the art and is shown below:

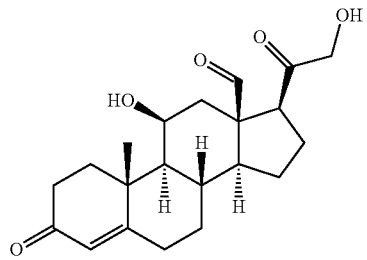

The terms "biological effects associated with ACTH" and "ACTH activity" are used interchangeably and include any biological effect of ACTH. In certain embodiments, ACTH activity includes the ability of ACTH to interact or bind to a receptor. In some embodiments, ACTH activity is represented by the ability of ACTH to bind to a melanocortin receptor (MCR). In some embodiments, ACTH binds to and activates MC2R in the adrenal cortex, thereby resulting in the production of cAMP, which activates PKA which in turn activates enzymes that convert cholesterol to cortisol, i.e., ACTH signaling through MC2R induces cortisol secretion. ACTH can also bind to MC1R, MC3R, MC4R and/or MC5R and induce other biological effects.

The term "condition associated with elevated ACTH levels" refers to any condition, disorder and disease present in a subject who also has elevated plasma ACTH levels. Elevated ACTH levels are often associated with elevated cortisol levels since ACTH is the primary stimulator of adrenal cortisol production. ACTH and cortisol levels exhibit peaks (6-8 a.m.) and nadirs (11 p.m.). Only a small percentage of circulating cortisol is biologically active (i.e., free form), with the majority of cortisol inactive (i.e., protein bound). Cortisol is inactivated in the liver and excreted in the urine as conjugated compounds (e.g., 17-hydroxysteroids). Urine free cortisol levels reflect circulating free plasma cortisol levels. Since blood tests alone may not detect the presence of excessive cortisol secretion (since levels naturally vary throughout the day), testing for elevated cortisol generally involves a 24-hour urine free cortisol (UFC) measurement, cortisol saliva testing and blood tests. Measurement of ACTH levels, however, is most commonly achieved by blood testing. Typically, blood will be drawn in the morning to obtain a peak ACTH level and/or drawn in the evening to obtain a low (trough) ACTH level. Normal values for ACTH blood levels range from 9-52 pg/mL or 10-60 pg/mL for morning blood draws (there is no established reference value for evening blood draws). Higher than normal levels of ACTH may be present with hypertension, obstructive sleep apnea (OSA), congenital adrenal hyperplasia (CAH), Classical CAH, Nonclassical CAH, familial glucocorticoid deficiency (FGD), Allgrove syndrome, Nelson's Syndrome, subsequent to bilateral adenectomy, Cushing's Disease, or Cushing's Syndrome, and other diseases, disorders, and conditions.

As used herein, a "condition associated with ACTH" includes any disease, disorder, or condition that may be treated by antagonizing ACTH, for example by administration of an anti-ACTH antibody or antigen-binding fragment thereof according to the invention. Said disease, disorder, or condition may be characterized by elevated ACTH. Said disease, disorder, or condition may be characterized by changes in the level of a substance or in a biological process that can be ameliorated or reversed by antagonizing ACTH, including diseases, disorders, or conditions associated with elevated cortisol or aldosterone, wherein antagonism of ACTH may reduce said level of cortisol or aldosterone. Said diseases, disorders, or conditions include those associated with a symptom that can be ameliorated by antagonizing ACTH, whether or not ACTH is thought to play a causative role in the disease. Additional terms that are used interchangeably with "condition associated with ACTH" include "disease associated with ACTH" as well as the terms "ACTH-related", "ACTH-induced", "ACTH-driven", "ACTH-mediated" and "ACTH-associated" when used in the context of diseases, disorders, or conditions. Examples of conditions associated with ACTH include, without limitation thereto, ACTH-driven hypercortisolism, acute coronary syndrome, acute heart failure, Alzheimer's disease, anxiety disorders, atherosclerosis, atrial fibrillation, cachexia, cancer (such as Cushing's Syndrome resulting from ectopic ACTH expression, e.g., in small cell lung cancer, non-small cell lung cancer (NSCLC), pancreatic carcinoma, neural tumors, or thymoma), cardiac conditions, cardiac fibrosis, cardiovascular disorders, chronic renal failure, chronic stress syndrome, cognitive dysfunction, congenital adrenal hyperplasia (CAH), Classical CAH, Non-classical CAH, familial glucocorticoid deficiency (FGD), Allgrove syndrome, Nelson's syndrome, congestive heart failure, Conn's syndrome, coronary heart diseases, Cushing's Disease, Cushing's Syndrome, depression, diabetes, endothelial dysfunction, exercise intolerance, familial hyperaldosteronism, fibrosis, galactorrhea, heart failure, hyperaldosteronism, hypercortisolemia, hypertension, hypokalemia, impaired cardiac function, increased formation of collagen, inflammation, metabolic syndrome, muscle atrophy, conditions associated with muscle atrophy, myocardiac fibrosis, nephropathy, obesity, post-myocardial infarction, primary hyperaldosteronism, remodeling following hypertension, renal failure, restenosis, secondary hyperaldosteronism, sleep apnea, and syndrome X. Said condition associated with ACTH may be treated in a human, or in a non-human animal such as dog, cat, or horse, or another animal species.

The term "condition associated with elevated cortisol, corticosterone and/or aldosterone levels" refers to any condition, disorder and disease present in a subject who also has elevated plasma cortisol, corticosterone and/or aldosterone levels. Elevated aldosterone levels or hyperaldosteronism are associated with conditions such as primary hyperaldosteronism (including Conn's syndrome), secondary hyperaldosteronism, and familial hyperaldosteronism. Elevated cortisol levels, for example, are often associated with conditions such as anxiety disorders, stress, depression, obesity, cancer, muscle atrophy, hypertension, heart failures, diabetes, sleep apnea, hyperinsulinemia, Alzheimer's disease, dementia and other cognitive dysfunction, galactorrhea, metabolic syndrome, Cushing's Syndrome and Cushing's Disease. Familial hyperaldosteronism includes a group of related heritable conditions that result in excessive production of aldosterone. Familial hyperaldosteronism patients often exhibit severe hypertension, and may exhibit enlarged adrenal glands. Familial hyperaldosteronism can be categorized into three types, distinguished by their clinical features and genetic causes. In familial hyperaldosteronism type I, hypertension generally appears in childhood to early adulthood and can range from mild to severe. This type can be treated with steroid medications called glucocorticoids, so it is also known as glucocorticoid-remediable aldosteronism (GRA). One known genetic cause of familial hyperaldosteronism type I is the fusion the genes CYP11B1 and CYP11B2, which are located close together on chromosome 8. In familial hyperaldosteronism type II, hypertension usually appears in early to middle adulthood and does not improve with glucocorticoid treatment. In most individuals with familial hyperaldosteronism type III, the adrenal glands are enlarged up to six times their normal size. These affected individuals have severe hypertension that starts in childhood. The hypertension is difficult to treat and often results in damage to organs such as the heart and kidneys. Rarely, individuals with type III have milder symptoms with treatable hypertension and no adrenal gland enlargement. Familial hyperaldosteronism type III can be caused by mutations in the KCNJ5 gene which encodes a potassium channel.

The term "Cushing's disease" refers to a serious condition of an excess level of the steroid hormone cortisol in the blood caused by a pituitary tumor secreting ACTH. Cushing's disease is rare, affecting 10 to 15 people per million each year, most commonly adults between 20 and 50 years of age. Women account for more than 70 percent of cases. Most subjects with Cushing's disease have small tumors (pituitary microadenomas). Cushing's disease is used exclusively to describe the condition of excessive cortisol arising from a pituitary tumor secreting the hormone ACTH. Magnetic resonance imaging (MRI) scan of the pituitary gland is the best way to detect the presence of an adenoma in Cushing's disease. MRI detects a pituitary adenoma in about 70 percent of cases. In the event that MRI scan fails to detect an abnormality despite indications of Cushing's disease via clinical findings and hormonal testing, inferior petrosal sinus sampling (IPSS) may be used to assess the ACTH levels in the inferior petrosal sinus compared to a vein just below the heart. In Cushing's disease, the ACTH level in the inferior petrosal sinus is much higher compared to the vein below the heart.

Cushing's disease is not the same as Cushing's Syndrome. The term "Cushing's Syndrome" refers to the general state characterized by excessive levels of cortisol in the blood. Elevated cortisol levels can occur for reasons other than a pituitary tumor, including, e.g., tumors of the adrenal glands producing cortisol; and ectopic ACTH production (i.e., certain types of cancer, elsewhere in the body, can make ACTH, which then stimulates the normal adrenal glands to make excessive cortisol). Cushing's Syndrome resulting from ectopic ACTH expression is frequently cause by neoplasms including small cell lung cancer, non-small cell lung cancer (NSCLC), pancreatic carcinoma, neural tumors (such as gliomas, neuroepitheliomatous tumors, or nerve sheath tumors) and thymoma. Small cell lung cancer is a particularly prominent as it has been observed to account for up to 50% of Cushing's Syndrome of ectopic or neoplastic origin.

Cushing's Syndrome is much more common than Cushing's disease. The most common cause of elevated cortisol levels is taking medications that have cortisol, including, but not limited to, hydrocortisone, prednisone pills, skin ointments, asthma inhalers and joint steroid injections. Other, albeit less common, causes of elevated cortisol levels include, for example, an adrenal tumor or "Pseudo-Cushing's" (i.e., chronically elevated levels of cortisol due to, e.g., depression, alcohol abuse, anorexia nervosa or high estrogen levels).

The term "congenital adrenal hyperplasia" or CAH refers to an autosomal recessive condition characterized by a congenital deficiency in cortisol production (reviewed in New et al. Congenital Adrenal Hyperplasia. [Updated 2013 Oct. 28]. In: De Groot et al., editors. Endotext [Internet]. South Dartmouth (MA): MDText.com, Inc.; 2000-. Available from: www.ncbi.nlm.nih.gov/books/NBK278953/, last retrieved Aug. 19, 2015, which is hereby incorporated by reference in its entirety). Genetic mutations within the biosynthesis pathway of cortisol have been identified as a cause of CAH. The most severe form of CAH is referred to as Classical CAH and is usually detected in the newborn or early childhood. Mutations in the cytochrome P450 21-hydroxylase gene (CYP21), which is important in the cortisol biosynthetic pathway, have been reported as one common cause of Classical CAH. The milder form of CAH, called Non-classical CAH (NCAH), is due to a partial enzyme deficiency and may cause symptoms at any time from infancy through adulthood. NCAH is much more common than Classical CAH. Cortisol provides negative feedback for corticotropin-releasing hormone (CRH) and ACTH production. The deficiency in cortisol production in CAH patients leads to excess ACTH secretion by the anterior pituitary as a result of this feedback, in an attempt to increase cortisol production. Thus, the lack of cortisol in CAH patients can result in an elevation of ACTH levels. The chronic high levels of ACTH can lead to an accumulation of cortisol precursors, which in turn can result in increased androgen production. Specifically, the rise in ACTH stimulates the adrenal steroid pathway, but because of the defect in the cortisol biosynthesis pathway (e.g., a block at 21-hydroxylation) there is a buildup in steroid precursors (such as 17-hydroxyprogesterone (17-OHP)), which can be androgenic. Thus, CAH patients typically exhibit low to no cortisol production, increased ACTH levels, and excess androgen production. This build up in androgenic steroid precursors has important implications for the fetus, infant, child and adult with CAH.

For a female CAH patient, the buildup in androgens can result in a virilized fetus with ambiguous genitalia. In the infant and child the androgens can cause pseudo-precocious puberty with excess growth and virilization. Without effective treatment, the child will go through a very early puberty, resulting in a shortened stature. In the adult, CAH is associated with infertility, virilization of the female and steroid deficiency.

Males with CAH, particularly if inadequately treated, may have reduced sperm counts and low testosterone as a result of small testes due to suppression of gonadotropins and sometimes intra-testicular adrenal rests. All of these complications may result in diminished fertility (www.ncbi.nlm.nih.gov/books/NBK278953/). In addition high ACTH levels in CAH patients have been associated with testicular adrenal rest tumors (Delfino et. al., J Ultrasound Med. 2012 March; 31(3):383-8.)

There are various treatment regimens available which attempt to provide adequate steroid levels during the day and counter the buildup of ACTH at night. A common regimen used in children is twice or thrice daily hydrocortisone. This treatment regimen provides supra-physiological levels of hydrocortisone within 1-2 hours of dosing (Charmandari et al., 2001) and doesn't prevent the early morning rise in ACTH and androgenic precursors (Scott et al., 1978; Cutler, 1996). Alternative treatment regimens involve giving a dose of steroids at night, which does not reflect normal circadian rhythms and may affect the patient's sleeping pattern; additionally, such treatment regimens can incur a greater risk of giving excessive steroid doses, as the patient still receives steroid replacement during the day.

Treatment of CAH involves steroid replacement, typically glucocorticoid replacement. Steroid replacement can both functionally replace the low/absent cortisol and reduce androgenic precursors. Glucocorticoid replacement is typically administered to reduce hyperplasia and reduce overproduction of androgens. The steroid may replacement therapy may include hydrocortisone, prednisolone, or dexamethasone, or another steroid having glucocorticoid and/or mineralocorticoid activity. Steroid replacement therapy at the dosages effective to treat CAH can cause side-effects, such as reducing growth in the child and causing thin bones and skin in the adult as well as potentially leading to Cushing's syndrome and/or metabolic syndrome. Moreover, even with cortisol supplementation, ACTH levels may not be sufficiently suppressed to control the excess androgen production.

Excess androgen production in CAH patients may be treated with antiandrogens (such as flutamide, gonadotropin-releasing hormone analogs, leuprolide, cyproterone (such as cyproterone acetate), enzalutamide, galeterone, abiraterone (e.g., abiraterone acetate), and/or orteronel); and/or nonsteroidal antiandrogens (such as flutamide, VT-464, aminoglutethimide, and/or enzalutamide), and/or another androgen receptor antagonist or androgen biosynthesis inhibitor. Patients may also be administered an aromatase inhibitor to slow skeletal maturation. Additionally, puberty may be suppressed by administration of long-acting gonadotropin-releasing hormone (GnRH) agonists, and stimulating growth with growth hormone may partially improve the patient's height. Replacement testosterone and/or estrogen may be administered if the patient is deficient, e.g., at puberty. Additionally, salt wasting, if present, can be treated with dietary supplementation with sodium chloride. Patients may alternatively, or in addition, be administered an aldosterone replacement such as fludrocortisone (e.g., fludrocortisone acetate). Medication may be increased in response to illness and/or stress ("stress-dosing").

As further disclosed herein, the present disclosure provides a method of treating CAH comprising administering an anti-ACTH antibody to a patient in need thereof. Without intent to be limited by theory, it is believed that, by antagonizing ACTH in vivo, the anti-ACTH antibodies can prevent the effects of elevated ACTH present in CAH patients, including stimulation of the adrenal steroid pathway, such as the buildup in androgenic steroid precursors (e.g., 17-hydroxyprogesterone (17-OHP)) can be decreased or prevented. Said anti-ACTH antibody may be administered in an amount effective to treat CAH or to treat or prevent one or more symptoms associated therewith, such as elevated production of or levels of 17-hydroxyprogesterone (17-OHP) or another androgenic steroid precursor, and/or elevated production of or levels of an androgen such as testosterone, dihydrotestosterone (DHT) and/or androstenedione, and/or virilization. Said patient may be further administered one or more of: antiandrogens, flutamide, gonadotropin-releasing hormone analogs, leuprolide, cyproterone, cyproterone acetate, enzalutamide, galeterone, abiraterone, abiraterone acetate, orteronel, steroidal antiandrogens, flutamide, VT-464, aminoglutethimide, enzalutamide, an androgen receptor antagonist, an androgen biosynthesis inhibitor, an aromatase inhibitor, a long-acting gonadotropin-releasing hormone (GnRH) agonists, and/or growth hormone, which optionally may be administered concurrently, sequentially, together or separately with said anti-ACTH antibody. Said patient may be further administered replacement testosterone, dihydrotestosterone (DHT), androstenedione, and/or estrogen, which optionally may be administered concurrently, sequentially, together or separately with said anti-ACTH antibody.

Familial glucocorticoid deficiency (FGD) or hereditary unresponsiveness to ACTH is characterized by isolated glucocorticoid deficiency and includes FGF types 1 and 2. Rare, autosomal recessive forms of this disorder result from mutations in genes encoding either the ACTH receptor (melanocortin 2 receptor (MC2R)) or its accessory protein (melanocortin 2 receptor accessory protein (MRAP)), which are respectively categorized as FGD type 1 and 2. FGD patients do not respond appropriately to ACTH and produce little to no cortisol. Since cortisol negatively regulates ACTH, the lack of cortisol stimulates very high levels of ACTH that has phenotypic effects (see Chung et al., "Phenotypic characteristics of familial glucocorticoid deficiency (FGD) type 1 and 2." Clinical Endocrinology, 72:589-594 (2010), which is hereby incorporated by reference in its entirety). FGD patients frequently present with hypoglycaemia, seizure, jaundice, hyperpigmentation, failure to thrive and frequent or severe infections. FGD patients also typically exhibit a markedly elevated plasma ACTH in the presence of low cortisol but with a preserved mineralocorticoid production.

As further disclosed herein, the present disclosure provides a method of treating FGD comprising administering an effective amount of an anti-ACTH antibody to a patient in need thereof. Without intent to be limited by theory, it is believed that, by antagonizing ACTH in vivo, the anti-ACTH antibodies can prevent the effects of elevated ACTH present in FGD patients, including but not limited to hypoglycaemia, seizure, jaundice, hyperpigmentation, failure to thrive and frequent or severe infections. Said anti-ACTH antibody may be administered in an amount effective to treat FGD or to treat or prevent one or more symptoms associated therewith. Optionally said treatment of FGD may further comprise administration of glucocorticoid replacement therapy to the patient, e.g., administration of one or more glucocorticoids and/or agents having glucocorticoid activity (such as agents having both glucocorticoid and mineralocorticoid activity), such as cortisol (hydrocortisone), cortisone, prednisone, prednisolone, methylprednisolone, dexamethasone, betamethasone, triamcinolone, beclometasone, and/or fludrocortisone (e.g., fludrocortisone acetate).

The present disclosure also provides a method of treating Nelson's syndrome (also known as post adrenalectomy syndrome) or elevated ACTH levels subsequent to bilateral adenectomy, comprising administering an effective amount of an anti-ACTH antibody to a patient in need thereof. Nelson's syndrome can occur in patients who have had both adrenal glands removed, e.g., for the treatment of Cushing's disease, sometimes occurring many years after bilateral adrenalectomy. The disorder is characterized by elevated levels of ACTH. Without intent to be limited by theory, it is believed that, by antagonizing ACTH in vivo, the anti-ACTH antibodies can prevent the effects of elevated ACTH present in Nelson's syndrome patients. Said anti-ACTH antibody may be administered in an amount effective to treat Nelson's syndrome or to treat or prevent one or more symptoms associated therewith. Optionally said treatment may further comprise administration of glucocorticoid replacement therapy to the patient, e.g., one or more corticosteroids, including glucocorticoids and/or mineralocorticoids (including agents having one or both of glucocorticoid and/or mineralocorticoid activity), such as cortisol (hydrocortisone), cortisone, prednisone, prednisolone, methylprednisolone, dexamethasone, betamethasone, triamcinolone, beclometasone, fludrocortisone (e.g., fludrocortisone acetate), deoxycorticosterone (e.g., deoxycorticosterone acetate (DOCA)), and/or aldosterone.

The present disclosure also provides a method of treating triple A syndrome, also known as Allgrove syndrome or "4 A" syndrome, comprising administering an effective amount of an anti-ACTH antibody to a patient in need thereof. This syndrome is characterized by the clinical triad of adrenocorticotropic hormone (ACTH)-resistant adrenal failure, achalasia of the cardia and alacrima, and further is associated with variable and progressive neurological impairment involving the central, peripheral and autonomic nervous systems. The syndrome is also referred to in the literature as "4 A" syndrome. Dermatological features such as palmoplantar hyperkeratosis, as well as other signs including short stature, osteoporosis and microcephaly, point to the multisystemic character of the disorder which may severely impair life quality in affected individuals. Allgrove syndrome patients exhibit chronically elevated levels of ACTH and, without intent to be limited by theory, it is believed that antagonism of ACTH, e.g., using an anti-ACTH antibody, may counteract some effects of the chronically elevated ACTH levels in Allgrove syndrome patients, thereby providing therapeutic benefit.

The term "sleep disorder" means any condition associated with irregular sleep patterns, e.g., sleep apnea, insomnia, hypersomnia, narcolepsy and other dyssomnias.

The term "sleep apnea" refers to a potentially serious sleep disorder in which breathing repeatedly stops and starts. There are two main types of sleep apnea: (1) obstructive sleep apnea (OSA), which is the more common form, that occurs when throat muscles relax; and (2) central sleep apnea (CSA), which occurs when your brain doesn't send proper signals to the muscles that control breathing. OSA occurs when the muscles in the back of the throat, which support the soft palate, the uvula, the tonsils, the side walls of the throat and the tongue, relax such that the airway narrows or closes preventing an adequate breath in. This may lower the level of oxygen in your blood. The brain senses the inability to breathe and briefly rouses a person from sleep in order to reopen the airway. The awakening is usually so brief that it is not remembered. In fact, a person with OSA may not be aware that their sleep was disrupted, i.e., some people with this type of sleep apnea think they sleep well all night. A person may also make a snorting, choking or gasping sound. The pattern of sleep/awake can repeat itself, e.g., 5 to 30 times or more each hour, all night. These disruptions impair the ability to reach the desired deep, restful phases of sleep, and often result in a person suffering from OSA feeling sleepy during their waking hours. CSA, which is much less common than OSA, occurs when the brain fails to transmit signals to the breathing muscles. A person with CSA may awaken with shortness of breath and/or have a difficult time getting to sleep or staying asleep. As with OSA, snoring and daytime sleepiness can occur. The most common cause of CSA is heart failure and, less commonly, a stroke. People with CSA may be more likely to remember awakening than are people with OSA.

The signs and symptoms of OSA and CSA can overlap, which makes it difficult to identify the type of sleep apnea. The most common signs and symptoms of obstructive and central sleep apneas include: excessive daytime sleepiness (hypersomnia); loud snoring (usually more prominent in OSA); episodes of breathing cessation during sleep witnessed by another person; abrupt awakenings accompanied by shortness of breath (more likely indicates CSA); awakening with a dry mouth or sore throat; morning headache; difficulty staying asleep (insomnia); and/or attention problems.

Although sleep apnea can affect anyone, including children, there are certain factors associated with an increased risk of sleep apnea. Risk factors for OSA include, but are not limited to, excess weight (i.e., fat deposits around your upper airway may obstruct your breathing); neck circumference (i.e., people with a thicker neck may have a narrower airway; a narrowed airway (i.e., a naturally narrow throat and/or enlarged tonsils or adenoids); gender (i.e., men are twice as likely as woman to develop sleep apnea, although a woman's risk is increased if she is overweight and/or post-menopanusal); age (i.e., sleep apnea occurs significantly more often in adults older than 60); family history (i.e., increased risk for individuals who have family members with sleep apnea); race (i.e., in people under 35 years old, people of African descent are more likely to have obstructive sleep apnea); use of alcohol, sedatives or tranquilizers which relax the muscles in your throat; smoking (i.e., smokers are three times more likely to have OSA than non-smokers due to, e.g., increased inflammation and fluid retention in the upper airway); nasal congestion (i.e., difficulty breathing through your nose, e.g., whether an anatomical problem or allergies, is associated with increased likelihood of developing OSA). Risk factors for CSA include, but are not limited to, gender (i.e., males at increased risk); age (i.e., people over 65 years of age have a higher risk of CSA); heart disorders (i.e., people with atrial fibrillation or congestive heart failure are more at risk of CSA); and stroke or brain tumor (i.e., these conditions can impair the brain's ability to regulate breathing.

Sleep apnea is considered a serious medical condition with complications including, but not limited to, high blood pressure (i.e., hypertension) and heart problems, daytime fatigue, depression, behavioral problems, problems with medications and/or surgery, liver problems and sleep-deprived partners.

"About" where used means especially ±10%, ±5% or ±3% (referring to the given numeric value, respectively), if not indicated otherwise. In each of the invention embodiments, "about" can be deleted.

The term "host cell" herein in general refers to any cell engineered to express one or more antibody polypeptides according to the invention. This includes by way of example bacterial, fungal, yeast, mammalian, invertebrate such as insect, plant and avian cells. Preferred host cells are yeast, fungi, especially filamentous fungi and mammalian cells. Yeast and filamentous fungi include, but are not limited to *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa*.

Examples of invertebrate cells include insect cells such as *Drosophila* S2 and *Spodoptera* Sf9, as well as plant cells. Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., *J. Gen Virol.*, 36:59 (1977)); Chinese hamster ovary cells/-DHFR (CHO, Urlaub and Chasin, *PNAS USA*, 77:4216 (1980)); mouse Sertoli cells (TM4, Mather, *Biol. Reprod.*, 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art. Preferred mammalian cells for antibody expression include CHO cells and COS cells. In an exemplary embodiment the recombinant host cells are polyploid yeast cells of the genus *Pichia*.

Mating competent yeast species: In the present invention this is intended to broadly encompass any diploid or tetraploid yeast which can be grown in culture. Such species of yeast may exist in a haploid, diploid, or other polyploid form. The cells of a given ploidy may, under appropriate conditions, proliferate for an indefinite number of generations in that form. Diploid cells can also sporulate to form haploid cells. Sequential mating can result in tetraploid strains through further mating or fusion of diploid strains. The present invention contemplates the use of haploid yeast, as well as diploid or other polyploid yeast cells produced, for example, by mating or spheroplast fusion.

Mating competent yeast include yeast which are a member of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis*; and *Zygosaccharomyces*. Other types of yeast potentially useful in the invention include *Yarrowia; Rhodosporidium; Candida; Hansenula; Filobasium; Sporidiobolus; Bullera; Leucosporidium* and *Filobasidella*.

In a preferred embodiment of the invention, the mating competent yeast is a member of the genus *Pichia*. In a further preferred embodiment of the invention, the mating competent yeast of the genus *Pichia* is one of the following species: *Pichia pastoris, Pichia methanolica*, and *Hansenula polymorpha* (*Pichia angusta*). In a particularly preferred embodiment of the invention, the mating competent yeast of the genus *Pichia* is the species *Pichia pastoris*.

Haploid Yeast Cell: A cell having a single copy of each gene of its normal genomic (chromosomal) complement.

Polyploid Yeast Cell: A cell having more than one copy of its normal genomic (chromosomal) complement.

Diploid Yeast Cell: A cell having two copies (alleles) of essentially every gene of its normal genomic complement, typically formed by the process of fusion (mating) of two haploid cells.

Tetraploid Yeast Cell: A cell having four copies (alleles) of essentially every gene of its normal genomic complement, typically formed by the process of fusion (mating) of two haploid cells. Tetraploids may carry two, three, four or more different expression cassettes. Such tetraploids might be obtained in *S. cerevisiae* by selective mating homozygotic heterothallic a/a and alpha/alpha diploids and in *Pichia* by sequential mating of haploids to obtain auxotrophic diploids. For example, a [met his] haploid can be mated with [ade his] haploid to obtain diploid [his]; and a [met arg] haploid can be mated with [ade arg] haploid to obtain diploid [arg]; then the diploid [his]×diploid [arg] to obtain a tetraploid prototroph. It will be understood by those of skill in the art that reference to the benefits and uses of diploid cells may also apply to tetraploid cells.

Yeast Mating: The process by which two haploid yeast cells naturally fuse to form one diploid yeast cell.

Meiosis: The process by which a diploid yeast cell undergoes reductive division to form four haploid spore products. Each spore may then germinate and form a haploid vegetatively growing cell line.

Selectable Marker: A selectable marker is a gene or gene fragment that confers a growth phenotype (physical growth characteristic) on a cell receiving that gene as, for example through a transformation event. The selectable marker allows that cell to survive and grow in a selective growth medium under conditions in which cells that do not receive that selectable marker gene cannot grow. Selectable marker genes generally fall into several types, including positive selectable marker genes such as a gene that confers on a cell resistance to an antibiotic or other drug, temperature when two temperature sensitive ("ts") mutants are crossed or a ts mutant is transformed; negative selectable marker genes such as a biosynthetic gene that confers on a cell the ability to grow in a medium without a specific nutrient needed by all cells that do not have that biosynthetic gene, or a mutagenized biosynthetic gene that confers on a cell inability to grow by cells that do not have the wild type gene; and the like. Suitable markers include but are not limited to: ZEO; G418; LYS3; MET1; MET3a; ADE1; ADE3; URA3; and the like.

Expression Vector: These DNA vectors contain elements that facilitate manipulation for the expression of a foreign protein within the target host cell. Conveniently, manipulation of sequences and production of DNA for transformation is first performed in a bacterial host, e.g. *E. coli*, and usually vectors will include sequences to facilitate such manipulations, including a bacterial origin of replication and appropriate bacterial selection marker. Selection markers encode proteins necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, (b) complement auxotrophic deficiencies, or (c) supply critical nutrients not available from complex media. Exemplary vectors and methods for transformation of yeast are described, for example, in Burke, D., Dawson, D., & Stearns, T. (2000). Methods in yeast genetics: a Cold Spring Harbor Laboratory course manual. Plainview, N.Y.: Cold Spring Harbor Laboratory Press.

Expression vectors for use in the methods of the invention will further include yeast specific sequences, including a selectable auxotrophic or drug marker for identifying transformed yeast strains. A drug marker may further be used to amplify copy number of the vector in a yeast host cell.

The polypeptide coding sequence of interest is operably linked to transcriptional and translational regulatory sequences that provide for expression of the polypeptide in yeast cells. These vector components may include, but are not limited to, one or more of the following: an enhancer element, a promoter, and a transcription termination sequence. Sequences for the secretion of the polypeptide may also be included, e.g. a signal sequence, and the like. A yeast origin of replication is optional, as expression vectors are often integrated into the yeast genome. In one embodiment of the invention, the polypeptide of interest is operably linked, or fused, to sequences providing for optimized secretion of the polypeptide from yeast diploid cells.

Nucleic acids are "operably linked" when placed into a functional relationship with another nucleic acid sequence. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites or alternatively via a PCR/recombination method familiar to those skilled in the art (Gateway Technology; Invitrogen, Carlsbad Calif.). If such sites do not exist, the synthetic oligonucleotide adapters or linkers are used in accordance with conventional practice.

Promoters are untranslated sequences located upstream (5') to the start codon of a structural gene (generally within about 100 to 1000 bp) that control the transcription and translation of particular nucleic acid sequences to which they are operably linked. Such promoters fall into several classes: inducible, constitutive, and repressible promoters (that increase levels of transcription in response to absence of a repressor). Inducible promoters may initiate increased levels of transcription from DNA under their control in response to some change in culture conditions, e.g., the presence or absence of a nutrient or a change in temperature.

The promoter fragment may also serve as the site for homologous recombination and integration of the expression vector into the same site in the host genome; alternatively a selectable marker is used as the site for homologous recombination.

Examples of suitable promoters useful in *Pichia* include the AOX1 promoter (Cregg et al. (1989) *Mol. Cell. Biol.* 9:1316-1323); ICL1 promoter (Menendez et al. (2003) *Yeast* 20(13):1097-108); glyceraldehyde-3-phosphate dehydrogenase promoter (GAP) (Waterham et al. (1997) *Gene* 186(1): 37-44); and FLD1 promoter (Shen et al. (1998) *Gene* 216(1):93-102). The GAP promoter is a strong constitutive promoter and the AOX and FLD1 promoters are inducible.

Other yeast promoters include ADH1, alcohol dehydrogenase II, GAL4, PHO3, PHO5, Pyk, and chimeric promoters derived therefrom. Additionally, non-yeast promoters may be used in the invention such as mammalian, insect, plant, reptile, amphibian, bacterial, fungal, viral, and avian promoters. Most typically the promoter will comprise a mammalian promoter (potentially endogenous to the expressed genes) or will comprise a yeast or viral promoter that provides for efficient transcription in yeast systems.

The polypeptides of interest may be produced recombinantly not only directly, but also as a fusion polypeptide with a heterologous polypeptide, e.g. a signal sequence or other polypeptide having a specific cleavage site at the N-terminus of the mature protein or polypeptide. In general, the signal sequence may be a component of the vector, or it may be a part of the polypeptide coding sequence that is inserted into the vector. The heterologous signal sequence selected preferably is one that is recognized and processed through one of the standard pathways available within the host cell. The *S. cerevisiae* alpha factor pre-pro signal has proven effective in the secretion of a variety of recombinant proteins from *P. pastoris*. Other yeast signal sequences include the alpha mating factor signal sequence, the invertase signal sequence, and signal sequences derived from other secreted yeast polypeptides. Additionally, these signal peptide sequences may be engineered to provide for enhanced secretion in diploid yeast expression systems. Other secretion signals of interest also include mammalian signal sequences, which may be heterologous to the protein being secreted, or may be a native sequence for the protein being secreted. Signal sequences include pre-peptide sequences, and in some instances may include propeptide sequences. Many such signal sequences are known in the art, including the signal sequences found on immunoglobulin chains, e.g., K28 pre-protoxin sequence, PHA-E, FACE, human MCP-1, human serum albumin signal sequences, human Ig heavy chain, human Ig light chain, and the like. For example, see Hashimoto et. al., *Protein Eng* 11(2) 75 (1998); and Kobayashi et. al., *Therapeutic Apheresis* 2(4) 257 (1998).

Transcription may be increased by inserting a transcriptional activator sequence into the vector. These activators are cis-acting elements of DNA, usually about from 10 to 300 bp, which act on a promoter to increase its transcription. Transcriptional enhancers are relatively orientation and position independent, having been found 5' and 3' to the transcription unit, within an intron, as well as within the coding sequence itself. The enhancer may be spliced into the expression vector at a position 5' or 3' to the coding sequence, but is preferably located at a site 5' from the promoter.

Expression vectors used in eukaryotic host cells may also contain sequences necessary for the termination of transcription and for stabilizing the mRNA. Such sequences are commonly available from 3' to the translation termination codon, in untranslated regions of eukaryotic or viral DNAs or cDNAs. These regions contain nucleotide segments transcribed as polyadenylated fragments in the untranslated portion of the mRNA.

Construction of suitable vectors containing one or more of the above-listed components employs standard ligation techniques or PCR/recombination methods. Isolated plasmids or DNA fragments are cleaved, tailored, and re-ligated in the form desired to generate the plasmids required or via recombination methods. For analysis to confirm correct sequences in plasmids constructed, the ligation mixtures are used to transform host cells, and successful transformants selected by antibiotic resistance (e.g. ampicillin or Zeocin) where appropriate. Plasmids from the transformants are prepared, analyzed by restriction endonuclease digestion and/or sequenced.

As an alternative to restriction and ligation of fragments, recombination methods based on att sites and recombination enzymes may be used to insert DNA sequences into a vector. Such methods are described, for example, by Landy (1989) *Ann. Rev. Biochem.* 58:913-949; and are known to those of skill in the art. Such methods utilize intermolecular DNA recombination that is mediated by a mixture of lambda and *E. coli*-encoded recombination proteins. Recombination occurs between specific attachment (att) sites on the interacting DNA molecules. For a description of att sites see Weisberg and Landy (1983) Site-Specific Recombination in Phage Lambda, in Lambda II, Weisberg, ed. (Cold Spring Harbor, N.Y.: Cold Spring Harbor Press), pp. 211-250. The DNA segments flanking the recombination sites are switched, such that after recombination, the att sites are hybrid sequences comprised of sequences donated by each parental vector. The recombination can occur between DNAs of any topology.

Att sites may be introduced into a sequence of interest by ligating the sequence of interest into an appropriate vector; generating a PCR product containing att B sites through the use of specific primers; generating a cDNA library cloned into an appropriate vector containing att sites; and the like.

Folding, as used herein, refers to the three-dimensional structure of polypeptides and proteins, where interactions between amino acid residues act to stabilize the structure.

While non-covalent interactions are important in determining structure, usually the proteins of interest will have intra- and/or intermolecular covalent disulfide bonds formed by two cysteine residues. For naturally occurring proteins and polypeptides or derivatives and variants thereof, the proper folding is typically the arrangement that results in optimal biological activity, and can conveniently be monitored by assays for activity, e.g. ligand binding, enzymatic activity, etc.

In some instances, for example where the desired product is of synthetic origin, assays based on biological activity will be less meaningful. The proper folding of such molecules may be determined on the basis of physical properties, energetic considerations, modeling studies, and the like.

The expression host may be further modified by the introduction of sequences encoding one or more enzymes that enhance folding and disulfide bond formation, i.e. foldases, chaperonins, etc. Such sequences may be constitutively or inducibly expressed in the yeast host cell, using vectors, markers, etc. as known in the art. Preferably the sequences, including transcriptional regulatory elements sufficient for the desired pattern of expression, are stably integrated in the yeast genome through a targeted methodology.

For example, the eukaryotic PDI is not only an efficient catalyst of protein cysteine oxidation and disulfide bond isomerization, but also exhibits chaperone activity. Co-expression of PDI can facilitate the production of active proteins having multiple disulfide bonds. Also of interest is the expression of BIP (immunoglobulin heavy chain binding protein); cyclophilin; and the like. In one embodiment of the invention, each of the haploid parental strains expresses a distinct folding enzyme, e.g. one strain may express BIP, and the other strain may express PDI or combinations thereof.

The terms "desired protein" or "desired antibody" are used interchangeably and refer generally to a parent antibody or fragment specific to a target, i.e., ACTH or a chimeric or humanized antibody or a binding portion thereof derived therefrom or one containing the same CDRs or epitopic specificity as any of the anti-ACTH antibodies or fragments described herein. The term "antibody" is intended to include any polypeptide chain-containing molecular structure with a specific shape that fits to and recognizes an epitope, where one or more non-covalent binding interactions stabilize the complex between the molecular structure and the epitope. The archetypal antibody molecule is the immunoglobulin, and all types of immunoglobulins, IgG, IgM, IgA, IgE, IgD, etc., from all sources, e.g. human, rodent, rabbit, cow, sheep, pig, dog, other mammals, chicken, other avians, etc., are considered to be "antibodies." A preferred source for producing antibodies useful as starting material according to the invention is rabbits. Numerous antibody coding sequences have been described; and others may be raised by methods well-known in the art. Examples thereof include chimeric antibodies, human antibodies and other non-human mammalian antibodies, humanized antibodies, single chain antibodies (such as scFvs), camelbodies, nanobodies, IgNAR (single-chain antibodies derived from sharks), small-modular immunopharmaceuticals (SMIPs), and antibody fragments such as Fabs, Fab', F(ab')$_2$, monovalent antibody fragments such as MetMab like molecules, and the like. See Streltsov V A, et al., Structure of a shark IgNAR antibody variable domain and modeling of an early-developmental isotype, *Protein Sci.* 2005 November; 14(11):2901-9. Epub 2005 Sep. 30; Greenberg A S, et al., A new antigen receptor gene family that undergoes rearrangement and extensive somatic diversification in sharks, *Nature.* 1995 Mar. 9; 374(6518): 168-73; Nuttall S D, et al., Isolation of the new antigen receptor from wobbegong sharks, and use as a scaffold for the display of protein loop libraries, Mol Immunol. 2001 August; 38(4):313-26; Hamers-Casterman C, et al., Naturally occurring antibodies devoid of light chains, *Nature.* 1993 Jun. 3; 363(6428):446-8; Gill D S, et al., Biopharmaceutical drug discovery using novel protein scaffolds, *Curr Opin Biotechnol.* 2006 December; 17(6):653-8. Epub 2006 Oct. 19.

The present invention includes in particular includes monovalent antibody molecules that bind ACTH, which are analogous to MetMab molecules. MetMab is a monovalent antibody specific to Met. (Met is a protein encoded by the nucleotide sequence set forth in Park et al., *PNAS USA* 84, 6379-83 (1987), or fragments thereof, as well as related polypeptides, which include, but are not limited to, allelic variants, splice variants, derivative variants, substitution variants, deletion variants, and/or insertion variants, fusion polypeptides, and interspecies homologs). The MetMab antibody, is a monovalent antibody known by different names including OA-5d5 (Genentech) and is also called One Armed 5d5, 5d5, MetMab, PRO143966, among others). Antibody OA-5d5, including its structure and properties, and methods for making and using it, are described in U.S. Publication No. 2007/0092520. In one embodiment, an anti-ACTH antibody according to the invention may comprise a single Fab region linked to an Fc region. In such embodiment, an antibody of the invention may comprise light and heavy chain variable domains as described herein. In such an embodiment, the antibody is monovalent and may comprise an intact Fc region. In another such embodiment, the Fc region may comprise at least one protuberance (knob) and at least one cavity (hole), wherein the presence of the protuberance and cavity enhances formation of a complex between an Fc polypeptide comprising the protuberance and an Fc polypeptide comprising the cavity, for example as described in WO 2005/063816. In one embodiment, the Fc region of an antibody of the invention may comprise a first and a second Fc polypeptide, wherein the first and second polypeptide each comprises one or more mutations with respect to wild type human Fc. In one embodiment, a cavity mutation is T366S, L368A and/or Y407V. In another embodiment, a protuberance mutation is T366W. In a specific embodiment, a monovalent antibody according to the subject invention may comprise a one-armed antibody synthesized as described in WO2005/063816. In such embodiment, the one-armed antibody may comprise Fc mutations constituting "knobs" and "holes" as described in WO2005/063816. For example, a hole mutation can be one or more of T366A, L368A and/or Y407V in an Fc polypeptide, and a cavity mutation can be T366W. The invention is also directed to an anti-human ACTH monovalent agent that binds with the same ACTH epitope and/or competes with an anti-ACTH antibody for binding to ACTH as an antibody or antibody fragment disclosed herein.

For example, antibodies or antigen binding fragments may be produced by genetic engineering. In this technique, as with other methods, antibody-producing cells are sensitized to the desired antigen or immunogen. The messenger RNA isolated from antibody producing cells is used as a template to make cDNA using PCR amplification. A library of vectors, each containing one heavy chain gene and one light chain gene retaining the initial antigen specificity, is produced by insertion of appropriate sections of the amplified immunoglobulin cDNA into the expression vectors. A combinatorial library is constructed by combining the heavy chain gene library with the light chain gene library. This results in a library of clones which co-express a heavy and light chain (resembling the Fab fragment or antigen binding fragment of an antibody molecule). The vectors that carry these genes are co-transfected into a host cell. When antibody gene synthesis is induced in the transfected host, the heavy and light chain proteins self-assemble to produce active antibodies that can be detected by screening with the antigen or immunogen.

Antibody coding sequences of interest include those encoded by native sequences, as well as nucleic acids that, by virtue of the degeneracy of the genetic code, are not identical in sequence to the disclosed nucleic acids, and variants thereof. Variant polypeptides can include amino acid (aa) substitutions, additions or deletions. The amino acid substitutions can be conservative amino acid substitutions or substitutions to eliminate non-essential amino acids, such as to alter a glycosylation site, or to minimize misfolding by substitution or deletion of one or more cysteine residues that are not necessary for function. Variants can be designed so as to retain or have enhanced biological activity of a particular region of the protein (e.g., a functional domain, catalytic amino acid residues, etc). Variants also include fragments of the polypeptides disclosed herein, particularly biologically active fragments and/or fragments corresponding to functional domains. Techniques for in vitro mutagenesis of cloned genes are known. Also included in the subject invention are polypeptides that have been modified using ordinary molecular biological techniques so as to improve their resistance to proteolytic degradation or to optimize solubility properties or to render them more suitable as a therapeutic agent.

As used herein, the terms "chimeric antibodies" and "chimerized antibodies" (as well as the respective singular forms thereof) are used interchangeably and have the same meaning. Chimeric antibodies generally comprise one or more variable domains of one species origin and a constant domain of another species origin. Most typically a chimeric antibody comprises variable heavy and variable light chain antibodies of non-human (e.g., rabbit, or rodent) one or both of which are linked to a constant domain of another species origin (e.g., human). Exemplary chimeric antibodies comprise a variable heavy chain of rabbit origin linked (e.g., fused) to a constant heavy chain of human origin, and may further contain a variable light chain of rabbit origin which may be linked (e.g., fused) to a light chain of human origin (or rabbit origin).

Chimeric antibodies may be made by recombinant means by combining the variable light and heavy chain regions ($V_L$ and $V_H$), obtained from antibody producing cells of one species with the constant light and heavy chain regions from another. Typically chimeric antibodies utilize rodent or rabbit variable regions and human constant regions, in order to produce an antibody with predominantly human domains. The production of such chimeric antibodies is well known in the art, and may be achieved by standard means (as described, e.g., in U.S. Pat. No. 5,624,659, incorporated herein by reference in its entirety). It is further contemplated that the human constant regions of chimeric antibodies of the invention may be selected from IgG1, IgG2, IgG3, and IgG4 constant regions.

Humanized antibodies are engineered to contain even more human-like immunoglobulin domains, and incorporate primarily the complementarity-determining regions of the animal-derived antibody. This is accomplished by carefully examining the sequence of the hyper-variable loops of the variable regions of the monoclonal antibody, and grafting them to the human antibody frameworks that are most similar to the rabbit sequence present in the particular antibody. This can also be achieved by fitting the CDRs to the structure of the human antibody chains. See, e.g., U.S. Pat. No. 6,187,287, incorporated fully herein by reference.

In addition to entire immunoglobulins (or their recombinant counterparts), immunoglobulin fragments comprising the epitope binding site (e.g., Fab', F(ab')$_2$, Fab, or other fragments) may be synthesized. "Fragment" or minimal immunoglobulins may be designed utilizing recombinant immunoglobulin techniques. For instance "Fv" immunoglobulins for use in the present invention may be produced by synthesizing a fused variable light chain region and a variable heavy chain region. Combinations of antibodies are also of interest, e.g. diabodies, which comprise two distinct Fv specificities. In another embodiment of the invention, SMIPs (small molecule immunopharmaceuticals), camelbodies, nanobodies, and IgNAR are encompassed by immunoglobulin fragments.

Immunoglobulins and fragments thereof may be modified post-translationally, e.g. to add effector moieties such as chemical linkers, detectable moieties, such as fluorescent dyes, enzymes, toxins, substrates, bioluminescent materials, radioactive materials, chemiluminescent moieties and the like, or specific binding moieties, such as streptavidin, avidin, or biotin, and the like may be utilized in the methods and compositions of the present invention. Examples of additional effector molecules are provided infra.

A polynucleotide sequence "corresponds" to a polypeptide sequence if translation of the polynucleotide sequence in accordance with the genetic code yields the polypeptide sequence (i.e., the polynucleotide sequence "encodes" the polypeptide sequence), one polynucleotide sequence "corresponds" to another polynucleotide sequence if the two sequences encode the same polypeptide sequence.

A "heterologous" region or domain of a DNA construct is an identifiable segment of DNA within a larger DNA molecule that is not found in association with the larger molecule in nature. Thus, when the heterologous region encodes a mammalian gene, the gene will usually be flanked by DNA that does not flank the mammalian genomic DNA in the genome of the source organism. Another example of a heterologous region is a construct where the coding sequence itself is not found in nature (e.g., a cDNA where the genomic coding sequence contains introns, or synthetic sequences having codons different than the native gene). Allelic variations or naturally-occurring mutational events do not give rise to a heterologous region of DNA as defined herein.

A "coding sequence" is an in-frame sequence of codons that (in view of the genetic code) correspond to or encode a protein or peptide sequence. Two coding sequences correspond to each other if the sequences or their complementary sequences encode the same amino acid sequences. A coding sequence in association with appropriate regulatory sequences may be transcribed and translated into a polypeptide. A polyadenylation signal and transcription termination sequence will usually be located 3' to the coding sequence. A "promoter sequence" is a DNA regulatory region capable of binding RNA polymerase in a cell and initiating transcription of a downstream (3' direction) coding sequence. Promoter sequences typically contain additional sites for binding of regulatory molecules (e.g., transcription factors) which affect the transcription of the coding sequence. A coding sequence is "under the control" of the promoter sequence or "operatively linked" to the promoter when RNA polymerase binds the promoter sequence in a cell and transcribes the coding sequence into mRNA, which is then in turn translated into the protein encoded by the coding sequence.

Vectors are used to introduce a foreign substance, such as DNA, RNA or protein, into an organism or host cell. Typical vectors include recombinant viruses (for polynucleotides) and liposomes (for polypeptides). A "DNA vector" is a replicon, such as plasmid, phage or cosmid, to which another polynucleotide segment may be attached so as to bring about the replication of the attached segment. An "expression vector" is a DNA vector which contains regulatory sequences which will direct polypeptide synthesis by an appropriate host cell. This usually means a promoter to bind RNA polymerase and initiate transcription of mRNA, as well as ribosome binding sites and initiation signals to direct translation of the mRNA into a polypeptide(s). Incorporation of a polynucleotide sequence into an expression vector at the proper site and in correct reading frame, followed by transformation of an appropriate host cell by the vector, enables the production of a polypeptide encoded by said polynucleotide sequence.

"Amplification" of polynucleotide sequences is the in vitro production of multiple copies of a particular nucleic acid sequence. The amplified sequence is usually in the form of DNA. A variety of techniques for carrying out such amplification are described in a review article by Van Brunt (1990, Bio/Technol., 8(4):291-294). Polymerase chain reaction or PCR is a prototype of nucleic acid amplification, and use of PCR herein should be considered exemplary of other suitable amplification techniques.

The general structure of antibodies in vertebrates now is well understood (Edelman, G. M., Ann. N.Y. Acad. Sci., 190: 5 (1971)). Antibodies consist of two identical light polypeptide chains of molecular weight approximately 25,000 Daltons (the "light chain"), and two identical heavy chains of molecular weight approximately 50,000 Daltons (the "heavy chain"). The four chains are joined by disulfide bonds in a "Y" configuration wherein the light chains bracket the heavy chains starting at the mouth of the "Y" configuration. The "branch" portion of the "Y" configuration is designated the $F_{ab}$ region; the stem portion of the "Y" configuration is designated the Fc region. The amino acid sequence orientation runs from the N-terminal end at the top of the "Y" configuration to the C-terminal end at the bottom of each chain. The N-terminal end possesses the variable region having specificity for the antigen that elicited it, and is approximately 100 amino acids in length, there being slight variations between light and heavy chain and from antibody to antibody.

The variable region is linked in each chain to a constant region that extends the remaining length of the chain and that within a particular class of antibody does not vary with the specificity of the antibody (i.e., the antigen eliciting it). There are five known major classes of constant regions that determine the class of the immunoglobulin molecule (IgG, IgM, IgA, IgD, and IgE corresponding to γ, μ, α, δ, and ε (gamma, mu, alpha, delta, or epsilon) heavy chain constant regions). The constant region or class determines subsequent effector function of the antibody, including activation of complement (Kabat, E. A., Structural Concepts in Immunology and Immunochemistry, 2nd Ed., p. 413-436, Holt, Rinehart, Winston (1976)), and other cellular responses (Andrews, D. W., et al., Clinical Immunobiology, pp 1-18, W. B. Sanders (1980); Kohl, S., et al., Immunology, 48: 187 (1983)); while the variable region determines the antigen with which it will react. Light chains are classified as either K (kappa) or a (lambda). Each heavy chain class can be prepared with either kappa or lambda light chain. The light and heavy chains are covalently bonded to each other, and the "tail" portions of the two heavy chains are bonded to each other by covalent disulfide linkages when the immunoglobulins are generated either by hybridomas or by B cells.

The expression "variable region" or "VR" refers to the domains within each pair of light and heavy chains in an antibody that are involved directly in binding the antibody to the antigen. Each heavy chain has at one end a variable domain ($V_H$) followed by a number of constant domains. Each light chain has a variable domain ($V_L$) at one end and a constant domain at its other end; the constant domain of the light chain is aligned with the first constant domain of the heavy chain, and the light chain variable domain is aligned with the variable domain of the heavy chain.

The expressions "complementarity determining region," "hypervariable region," or "CDR" refer to one or more of the hyper-variable or complementarity determining regions (CDRs) found in the variable regions of light or heavy chains of an antibody (See Kabat, E. A. et al., Sequences of Proteins of Immunological Interest, National Institutes of Health, Bethesda, Md., (1987)). These expressions include the hypervariable regions as defined by Kabat et al. ("Sequences of Proteins of Immunological Interest," Kabat E., et al., US Dept. of Health and Human Services, 1983) or the hypervariable loops in 3-dimensional structures of antibodies (Chothia and Lesk, J Mol. Biol. 196 901-917 (1987)). The CDRs in each chain are held in close proximity by framework regions and, with the CDRs from the other chain, contribute to the formation of the antigen binding site. Within the CDRs there are select amino acids that have been described as the selectivity determining regions (SDRs) which represent the critical contact residues used by the CDR in the antibody-antigen interaction (Kashmiri, S., Methods, 36:25-34 (2005)).

An "epitope" or "binding site" is an area or region on an antigen to which an antigen-binding peptide (such as an antibody) specifically binds. A protein epitope may comprise amino acid residues directly involved in the binding (also called immunodominant component of the epitope) and other amino acid residues, which are not directly involved in the binding, such as amino acid residues which are effectively blocked by the specifically antigen binding peptide (in other words, the amino acid residue is within the "footprint" of the specifically antigen binding peptide). The term epitope herein includes both types of amino acid binding sites in any particular region of ACTH that specifically binds to an anti-ACTH antibody. ACTH may comprise a number of different epitopes, which may include, without limitation, (1) linear peptide antigenic determinants, (2) conformational antigenic determinants which consist of one or more non-contiguous amino acids located near each other in a mature ACTH conformation; and (3) post-translational antigenic determinants which consist, either in whole or part, of molecular structures covalently attached to an ACTH protein such as carbohydrate groups.

The phrase that a first antibody binds "substantially" or "at least partially" the same epitope as a second antibody means that the epitope binding site for the first antibody comprises at least 10%, 20%, 30%, 40%, 50%, 60%, 70%, 80%, 90%, or more of the amino acid residues on the antigen that constitutes the epitope binding site of the second antibody. Also, that a first antibody binds substantially or partially the same or overlapping epitope as a second antibody means that the first and second antibodies compete in binding to the antigen, as described above. Thus, the term "binds to substantially the same epitope or determinant as" a monoclonal antibody means that an antibody "competes" with the antibody.

The phrase "binds to the same or overlapping epitope or determinant as" an antibody of interest means that an antibody "competes" with said antibody of interest for at least one, (e.g., at least 2, at least 3, at least 4, at least 5) or all residues on ACTH to which said antibody of interest specifically binds. The identification of one or more antibodies that bind(s) to substantially or essentially the same epitope as the monoclonal antibodies described herein can be readily determined using alanine scanning. Additionally, any one of variety of immunological screening assays in which antibody competition can be assessed. A number of such assays are routinely practiced and well known in the art (see, e.g., U.S. Pat. No. 5,660,827, issued Aug. 26, 1997, which is specifically incorporated herein by reference). It will be understood that actually determining the epitope to which an antibody described herein binds is not in any way required to identify an antibody that binds to the same or substantially the same or overlapping epitope as the monoclonal antibody described herein.

For example, where the test antibodies to be examined are obtained from different source animals, or are even of a different Ig isotype, a simple competition assay may be employed in which the control antibody is mixed with the test antibody and then applied to a sample containing ACTH. Protocols based upon ELISAs, radioimmunoassays, Western blotting, and the use of BIAcore® analysis are suitable for use in such simple competition studies.

In certain embodiments, one would pre-mix the control anti-ACTH antibody with varying amounts of the test antibody (e.g., in ratios of about 1:1, 1:2, 1:10 or about 1:100) for a period of time prior to applying to the ACTH antigen sample. In other embodiments, the control and varying amounts of test antibody can simply be added separately and admixed during exposure to the ACTH antigen sample. As long as one can distinguish bound from free antibodies (e.g., by using separation or washing techniques to eliminate unbound antibodies) and control antibody from the test antibody (e.g., by using species specific or isotype specific secondary antibodies or by specifically labeling the control antibody with a detectable label) one will be able to determine if the test antibody reduces the binding of the control antibody to the ACTH antigens, indicating that the test antibody recognizes substantially the same epitope as the control anti-ACTH antibody. The binding of the (labeled) control antibody in the presence of a completely irrelevant antibody (that does not bind ACTH) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of the control antibody to ACTH by at least about 50%, such as at least about 60%, or more preferably at least about 70% (e.g., about 65-100%), at any ratio of test antibody between about 1:1 or 1:10 and about 1:100 is considered to be an antibody that binds to substantially the same or overlapping epitope or determinant as the control antibody.

Preferably, such test antibody will reduce the binding of the control antibody to ACTH antigen preferably at least about 50%, at least about 60%, at least about 80% or at least about 90% (e.g., about 95%) of the binding of the control antibody observed in the absence of the test antibody.

A simple competition assay in which a test antibody is pre-adsorbed and applied at saturating concentration to a surface onto which ACTH is immobilized also may be advantageously employed. The surface in the simple competition assay is preferably a BIAcore® chip (or other media suitable for surface plasmon resonance analysis). The binding of a control antibody that binds ACTH to the ACTH-coated surface is measured. This binding to the ACTH-containing surface of the control antibody alone is compared with the binding of the control antibody in the presence of a test antibody. A significant reduction in binding to the ACTH-containing surface by the control antibody in the presence of a test antibody indicates that the test antibody recognizes substantially the same epitope as the control antibody such that the test antibody "competes" with the control antibody. Any test antibody that reduces the binding of control antibody by at least about 20% or more, at least about 40%, at least about 50%, at least about 70%, or more, can be considered to be an antibody that binds to substantially the same epitope or determinant as the control antibody. Preferably, such test antibody will reduce the binding of the control antibody to ACTH by at least about 50% (e.g., at least about 60%, at least about 70%, or more). It will be appreciated that the order of control and test antibodies can be reversed; i.e. the control antibody can be first bound to the surface and then the test antibody is brought into contact with the surface thereafter in a competition assay. Preferably, the antibody having greater affinity for ACTH antigen is bound to the ACTH-containing surface first, as it will be expected that the decrease in binding seen for the second antibody (assuming the antibodies are competing) will be of greater magnitude. Further examples of such assays are provided in e.g., Saunal and Regenmortel, (1995) *J. Immunol. Methods* 183: 33-41, the disclosure of which is incorporated herein by reference.

In addition, whether an antibody binds the same or overlapping epitope(s) on ACTH as another antibody or the epitope bound by a test antibody may in particular be determined using a western-blot based assay. In this assay a library of peptides corresponding to the antigen bound by the antibody, herein ACTH is made, which correspond to overlapping portions of the protein, typically 10-25, 10-20 or 10-15 amino acids long. These different overlapping amino acid peptides encompassing the ACTH sequence are synthesized and covalently bound to a PepSpots nitrocellulose membrane (JPT Peptide technologies, Berlin, Germany). Blots are then prepared and probed according to the manufacturer's recommendations.

Essentially, the immunoblot assay then detects by fluorometric means what peptides in the library bind to the test antibody and thereby can identify what residues on the antigen, i.e., ACTH, interact with the test antibody. (See an embodiment of this technique in U.S. Pat. No. 7,935,340, incorporated by reference herein).

The expressions "framework region" or "FR" refer to one or more of the framework regions within the variable regions of the light and heavy chains of an antibody (See Kabat, E. A. et al., Sequences of Proteins of Immunological Interest, National Institutes of Health, Bethesda, Md., (1987)). These expressions include those amino acid sequence regions interposed between the CDRs within the variable regions of the light and heavy chains of an antibody.

Anti-ACTH Antibodies and Binding Fragments Thereof Having Binding Activity for ACTH Adrenocorticotropic hormone (ACTH), also known as corticotropin, is a polypeptide tropic hormone produced and secreted by the anterior pituitary gland. It is an important component of the hypothalamic-pituitary-adrenal axis and is often produced in response to biological stress (along with its precursor corticotropin-releasing hormone from the hypothalamus). Its principal effects are increased production and release of corticosteroids. When a pituitary tumor is the cause of elevated ACTH (from the anterior pituitary) this is known as Cushing's Disease and the constellation of signs and symptoms of the excess cortisol (hypercortisolism) is known as Cushing's Syndrome. A deficiency of ACTH is a cause of secondary adrenal insufficiency. ACTH is also related to the circadian rhythm in many organisms. Moreover, elevated ACTH and cortisol production have been associated with sleep apnea, particularly OSA. See Henley et al., J Clin Endocrinol Metab. November 2009, 94(11): 4234-4242.

POMC, ACTH and β-lipotropin are secreted from corticotropes in the anterior lobe (or adenohypophysis) of the pituitary gland in response to the hormone corticotropin-releasing hormone (CRH) released by the hypothalamus. ACTH is synthesized from pre-pro-opiomelanocortin (pre-POMC). The removal of the signal peptide during translation produces the 241-amino acid polypeptide POMC, which undergoes a series of post-translational modifications such as phosphorylation and glycosylation before it is proteolytically cleaved by endopeptidases to yield various polypeptide fragments with varying physiological activity.

ACTH consists of 39 amino acids and can be processed into two shorter peptides, α-melanocyte-stimulating hormone (α-MSH) and CLIP. Alpha-MSH consists of amino acids 1-13 of human ACTH and CLIP consists of amino acids 18-39 of human ACTH. Human ACTH has a molecular weight of 4,540 atomic mass units (Da).

ACTH stimulates secretion of glucocorticoid steroid hormones from adrenal cortex cells, especially in the zona fasciculata of the adrenal glands. ACTH acts by binding to cell surface ACTH receptors, e.g., MC2R, which are located primarily on adrenocortical cells of the adrenal cortex. The ACTH receptor is a seven-membrane-spanning G protein-coupled receptor. Upon ligand binding, the receptor undergoes conformation changes that stimulate the enzyme adenylyl cyclase, which leads to an increase in intracellular cAMP and subsequent activation of protein kinase A.

ACTH influences steroid hormone secretion by both rapid short-term mechanisms that take place within minutes and slower long-term actions. The rapid actions of ACTH include stimulation of cholesterol delivery to the mitochondria where the P450scc enzyme is located. P450scc catalyzes the first step of steroidogenesis that is cleavage of the side-chain of cholesterol. ACTH also stimulates lipoprotein uptake into cortical cells. This increases the bio-availability of cholesterol in the cells of the adrenal cortex.

The long term actions of ACTH include stimulation of the transcription of the genes coding for steroidogenic enzymes, especially P450scc, steroid 11β-hydroxylase, and their associated electron transfer proteins. This effect is observed over several hours.

The present invention provides novel antibodies or antibody fragments that bind ACTH, including human ACTH. In preferred embodiments, the antibody or antibody fragment according to the invention comprises one or more complementarity determining regions (CDRs) of the anti-ACTH antibodies and antibody fragments described herein.

In some embodiments, an anti-ACTH antibody or antibody fragment according to the invention will interfere with, block, reduce or modulate the interaction between ACTH and MCRs (e.g., MC1R, MC2R, MC3R, MC4R and/or MC5R). In some instances an anti-ACTH antibody or antibody fragment according to the invention is denoted as "neutralizing", e.g., if it totally prevents the interaction of ACTH and MCR. In some embodiments, the antibody or antibody fragment neutralizes ACTH, e.g., by remaining bound to ACTH in a location and/or manner that prevents ACTH from binding to MCRs. This in turn results in a reduction in the amount of serum cortisol present in a subject.

In some embodiments, the antibody or antibody fragment according to the invention are capable of inhibiting ACTH-mediated activity (including binding). In some embodiments, the antibody or antibody fragment according to the invention are humanized, such as humanized rabbit antibodies to ACTH.

As mentioned, the anti-ACTH antibodies or antibody fragments according to the invention have a variety of utilities. For example, the subject antibodies and fragments are useful in therapeutic applications, as well as diagnostically in binding assays, and are useful for affinity purification of ACTH, in particular human ACTH or its ligands and in screening assays to identify other antagonists of ACTH activity. Some of the antibodies or antibody fragments according to the invention are useful for inhibiting binding of ACTH to MCRs, or inhibiting ACTH-mediated activities.

The antibody or antibody fragment according to the invention can be used in a variety of therapeutic applications. For example, in some embodiments the anti-ACTH antibody or antibody fragment according to the invention are useful for treating conditions associated with ACTH, such as congenital adrenal hyperplasia (CAH), Classical CAH, Non-classical CAH, familial glucocorticoid deficiency (FGD), Cushing's Disease, Cushing's Syndrome, obesity, diabetes, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophy, hypertension, sleep apnea, hyperinsulinemia, cognitive dysfunction, Alzheimer's disease, galactorrhea, stress related conditions, impaired cardiac function, exercise intolerance, heart failure and other cardiac conditions, metabolic syndrome, and hyperaldosteronism including primary hyperaldosteronism (such as Conn's syndrome), secondary hyperaldosteronism, and familial hyperaldosteronism, and other diseases, disorders, and conditions.

The subject anti-ACTH antibodies and antibody fragments according to the invention can in particular be used for treating any subject wherein blocking, inhibiting or neutralizing the in vivo effect of ACTH or blocking or inhibiting the interaction of ACTH and MCRs is therapeutically desirable, wherein the subject anti-ACTH antibodies or antibody fragments may be used alone or in association with other active agents or drugs.

Said treatment may include administration of another agent. Exemplary agents may be agents used for the treatment of a condition associated with ACTH, such as congenital adrenal hyperplasia (CAH), Classical CAH, Non-classical CAH, familial glucocorticoid deficiency (FGD), ACTH-driven hypercortisolism, acute coronary syndrome, acute heart failure, anxiety disorders, atherosclerosis, atrial fibrillation, cachexia, cancer (such as Cushing's Syndrome resulting from ectopic ACTH expression, e.g., in small cell lung cancer, non-small cell lung cancer (NSCLC), pancreatic carcinoma, neural tumors, or thymoma), cardiac conditions, cardiac fibrosis, cardiovascular disorders, chronic renal failure, chronic stress syndrome, cognitive dysfunction, Alzheimer's disease, congestive heart failure, Conn's syndrome, coronary heart diseases, Cushing's Disease, Cushing's Syndrome, depression, diabetes, endothelial dysfunction, exercise intolerance, familial hyperaldosteronism, fibrosis, galactorrhea, heart failure, hyperaldosteronism, hypercortisolemia, hypertension, hypokalemia, impaired cardiac function, increased formation of collagen, inflammation, metabolic syndrome, muscle atrophy, conditions associated with muscle atrophy, myocardiac fibrosis, nephropathy, obesity, post-myocardial infarction, primary hyperaldosteronism, remodeling following hypertension, renal failure, restenosis, secondary hyperaldosteronism, sleep apnea, or syndrome X, or for the treatment of a related condition such as hypercholesterolemia.

Additional exemplary agents that may be administered include (i) angiotensin II receptor antagonist or a pharmaceutically acceptable salt thereof, (ii) HMG-Co-A reductase inhibitor or a pharmaceutically acceptable salt thereof, (iii) angiotensin converting enzyme (ACE) Inhibitor or a pharmaceutically acceptable salt thereof, (iv) calcium channel blocker (CCB) or a pharmaceutically acceptable salt thereof, (v) dual angiotensin converting enzyme/neutral endopeptidase (ACE/NEP) inhibitor or a pharmaceutically acceptable salt thereof, (vi) endothelin antagonist or a pharmaceutically acceptable salt thereof, (vii) renin inhibitor or a pharmaceutically acceptable salt thereof, (viii) diuretic or a pharmaceutically acceptable salt thereof, (ix) an ApoA-1 mimic; (x) an anti-diabetic agent; (xi) an obesity-reducing agent; (xii) an aldosterone receptor blocker; (xiii) an endothelin receptor blocker; (xiv) a CETP inhibitor; (xv) an inhibitor of Na-K-ATPase membrane pump; (xvi) a beta-adrenergic receptor blocker or an alpha-adrenergic receptor blocker; and (xvii) a neutral endopeptidase (NEP) inhibitor; or any combination thereof.

Further non-limiting examples of drugs that may be co-administered with the subject antibodies or antibody fragments or used in the same therapeutic regimen include by way of example statins, ACE inhibitors, Angiotensin II receptor blockers (ARBs), antiarrhythmics, antiplatelet drugs, aspirin, beta blockers, amiodarone, digoxin, aspirin, anti-clotting agents, digoxin, diuretics, heart failure drugs, vasodilators, blood thinners, other anti-cholesterol drugs such as holestyramine (Questran), gemfibrozil (Lopid, Gemcor), Omacor, and pantethine, other anti-hypertensives, antidiabetogenic drugs such as alpha-glucosidase inhibitors, biguanides, dipeptidyl peptidase-4 inhibitors, insulin therapies, meglitinides, sulfonylurea, and thiazolidinediones, and other drugs used to treat hypertension and conditions that are frequently associated with hypertension (such as hypercholesterolemia, diabetes, metabolic syndrome, obesity, etc.).

ACE inhibitors may be used in combination with the subject anti-ACTH antibodies and antibody fragments wherein the moieties may be jointly or separately administered by the same or different means of administration include by way of example: Capoten (captopril), Vasotec (enalapril), Prinivil, Zestril (lisinopril), Lotensin (benazepril), Monopril (fosinopril), Altace (ramipril), Accupril (quinapril), Aceon (perindopril), Mavik (trandolapril), and Univasc (moexipril) as well as any pharmaceutically acceptable salts thereof.

ARBs may be used in combination with the subject anti-ACTH antibodies and antibody fragments wherein the moieties may be jointly or separately administered by the same or different means of administration include by way of example: Cozaar (losartan), Diovan (valsartan), Avapro (irbesartan), Atacand (candesartan), Micardis (telmisartan), eprosartan, olmesartan, saprisartan, tasosartan, E-4177, SC-52458, and ZD8731, as well as any pharmaceutically acceptable salts thereof.

Antiarrhythmics may be used in combination with the subject anti-ACTH antibodies and antibody fragments include by way of example: Tambocor (flecainide), Procanbid (procainamide), Cordarone (amiodarone), and Betapace (sotalol).

Anticlotting agents which may be used in combination with the subject anti-ACTH antibodies and antibody fragments wherein the moieties may be jointly or separately administered by the same or different means of administration include: Tissue plasminogen activator (TPA), Tenecteplase, Alteplase, Urokinase, Reteplase, and Streptokinase.

Beta-blockers may be used in combination with the subject anti-ACTH antibodies and antibody fragments wherein the agents may be jointly or separately administered by the same or different means of administration include by way of example: Sectral (acebutolol), Zebeta (bisoprolol), Brevibloc (esmolol), Inderal (propranolol), Tenormin (atenolol), Normodyne, Trandate (labetalol), Coreg (carvedilol), Lopressor, and Toprol-XL (metoprolol).

Calcium channel blockers which may be used in combination with the subject anti-ACTH antibodies and antibody fragments wherein the agents may be jointly or separately administered by the same or different means of administration include by way of example: Norvasc (amlodipine), Plendil (felodipine), Cardizem, Cardizem CD, Cardizem SR, Dilacor XR, Diltia XT, Tiazac (diltiazem), Calan, Calan SR, Covera-HS, Isoptin, Isoptin SR, Verelan, Verelan PM (verapamil), Adalat, Adalat CC, Procardia, Procardia XL (nifedipine), Cardene, Cardene SR (nicardipine), Sular (nisoldipine), Vascor (bepridil), and Caduet which is a combination of a statin cholesterol drug and amlodipine.

Diuretics which may be used in combination with the subject anti-ACTH antibodies and antibody fragments wherein the agents may be jointly or separately administered by the same or different means of administration include by way of example Lasix (furosemide), Bumex (bumetanide), Demadex (torsemide), Esidrix (hydrochlorothiazide), Zaroxolyn (metolazone), Aldactone (spironolactone), ethacrynic acid, ethynacrylic acid, mersalyl with theophylline, mercaptomerin sodium, merethoxylline procaine, amiloride, triamterene, chlorothalidone, chlorothiazide, quinethazone, hydroflumethiazide, methylchlorothiazide, and dichlorphenamide, including any pharmaceutically acceptable salts thereof.

Heart failure drugs which may be used in combination with the subject anti-ACTH antibodies and antibody fragments wherein the agents may be jointly or separately administered by the same or different means of administration include by way of example Dobutrex (dobutamine), and Primacor (milrinone).

Vasodilators which may be used in combination with the subject anti-ACTH antibodies and antibody fragments wherein the agents may be jointly or separately administered by the same or different means of administration include by way of example Dilatrate-SR, Iso-Bid, Isonate, Isorbid (isosorbide dinitrate), Isordil, Isotrate, Sorbitrate (isosorbide dinitrate), IMDUR (isosorbide mononitrate), and BiDil (hydralazine with isosorbide dinitrate.

Blood thinners which may be used in combination with the subject anti-ACTH antibodies and antibody fragments wherein the agents may be jointly or separately administered by the same or different means of administration include by way of example warfarin (Coumadin), Heparin, Lovenox, and Fragmin.

The subject anti-ACTH antibodies and antibody fragments according to the invention can further in particular be used for treating any subject wherein reducing cortisol and/or corticosterone levels is prophylactically or therapeutically desirable, wherein the subject anti-ACTH antibodies or antibody fragments may be used alone or in association with other active agents or drugs. These conditions include by way of example Cushing's Disease, Cushing's Syndrome, obesity, diabetes, sleep apnea, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophy, hypertension, hyperinsulinemia, cognitive dysfunction, Alzheimer's disease, galactorrhea, stress related conditions, impaired cardiac function, exercise intolerance, heart failure and other cardiac conditions, metabolic syndrome, hyperaldosteronism including primary hyperaldosteronism (such as Conn's syndrome) secondary hyperaldosteronism, and familial hyperaldosteronism, and other diseases, disorders, and conditions.

The subject anti-ACTH antibodies and antibody fragments according to the invention can also be used in any of the aforementioned therapeutic indications or conditions in combination with other drugs that are typically used to treat such disorders, wherein the antibody and other drug or agent may be co-administered or separately administered.

In particular, there are several pharmacological approaches to the treatment of Cushing's disease and/or Cushing's Syndrome. Drugs used to suppress cortisol secretion are mostly inhibitors of steroidogenesis, including, but not limited to, ketoconazole (Nizoral®), aminoglutethimide (Cytadren®), metyrapone (Metopirone®), mitotane (Lysodren®) and etomidate (Amidate®). Drugs that suppress adrenocorticotropic hormone (ACTH) secretion, e.g., cyproheptadine (Periactin® or Peritol®), valproic acid (Depakote®), cabergoline (Dostinex®), somatostatin analogs (e.g., pasireotide (Signifor®)), PPAR-gamma agonists (e.g., rosiglitazone (Avandia®)), vasopressin antagonists (i.e., Vaptans, including, but not limited to, conivaptan (Vaprisol®), tolvaptan (OPC-41061), lixivaptan (VPA-985), and satavaptan (SR121463, planned trade name Aquilda®)), may also be used. A third category of drugs is glucocorticoid receptor antagonists, e.g., mifepristone (Korlym®).

As noted above, the subject anti-ACTH antibodies may be used for the prevention or treatment of diseases and conditions associated with elevated aldosterone, and/or diseases and conditions treatable by decreasing aldosterone. Said diseases and conditions include hypertension, cardiovascular disorders, impaired cardiac function, exercise intolerance, heart failure (including congestive heart failure and acute heart failure), cardiac conditions, hypokalemia, atrial fibrillation, renal failure (e.g., chronic renal failure), restenosis, sleep apnea, atherosclerosis, syndrome X, obesity, nephropathy, post-myocardial infarction, coronary heart diseases, inflammation, increased formation of collagen, fibrosis such as cardiac or myocardiac fibrosis and remodeling following hypertension, endothelial dysfunction, cachexia, acute coronary syndrome, chronic stress syndrome, Cushing's disease, Cushing's Syndrome, metabolic syndrome, hypercortisolemia, and hyperaldosteronism (including primary hyperaldosteronism, secondary hyperaldosteronism, and familial hyperaldosteronism).

Additionally, there are several approaches to the management and/or treatment of sleep disorders, such as sleep apnea, insomnia or narcolepsy, ranging from lifestyle changes, such as losing weight or quitting smoking, to supplemental oxygen, medical devices, surgery and/or pharmaceuticals such as antidepressants and other drugs. Using supplemental oxygen while you sleep may treat sleep apnea. Various forms of oxygen are available as well as different devices to deliver oxygen to your lungs. Exemplary therapies include, but are not limited to, continuous positive airway pressure (CPAP); adjustable airway pressure devices (e.g., BPAP); expiratory positive airway pressure (EPAP); and oral appliances. CPAP therapy uses a machine to deliver air pressure, which is somewhat greater than that of the surrounding air, to keep your upper airway passages open, preventing apnea and snoring. Adjustable airway pressure devices provide an automatically adjusted air pressure to a subject while sleeping. For example, bilevel positive airway pressure (BPAP) therapy used a device that provides more pressure when you inhale and less when you exhale. EPAP is a small, single-use device that is placed over each nostril before going to sleep. The device is a valve that allows air to move freely in, but when you exhale, air must go through small holes in the valve which increases pressure in the airway and keeps it open. Also, adaptive servo-ventilation (ASV) is an airflow device that "learns" a person's normal breathing pattern and stores the information in a built-in computer so that after falling asleep, the machine uses pressure to normalize the breathing pattern and prevent pauses in your breathing. Another option is wearing an oral appliance designed to keep your throat open, e.g., by bringing your jaw forward. Additionally, surgical intervention (i.e., to enlarge the airway through your nose or throat) is another approach to the treatment of sleep apnea. Exemplary surgical options include, but are not limited to, tissue removal (i.e., uvulopalatopharyngoplasty (UPPP) and/or removal of tonsils and adenoids); jaw repositioning (i.e., maxillomandibular advancement); implants (e.g., implanting plastic rods into the soft palate); creating a new air passageway (i.e., tracheostomy); nasal surgery to remove polyps or straighten a crooked partition between your nostrils (e.g., deviated nasal septum); and surgery to remove enlarged tonsils or adenoids. Additionally, treating medical problems associated with sleep apnea, e.g., heart or neuromuscular disorders, may improve and/or eliminate the symptoms of central sleep apnea. Finally, drugs used to treat sleep apnea include, but are not limited to, armodafinil (Nuvigil®) and modafinil (Provigil®).

Examples of drugs that may be co-administered with the subject anti-ACTH antibodies or antibody fragments or in the same therapeutic regimen include, by way of example, ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®), and other drugs used to treat conditions wherein the treated individual may have elevated ACTH levels. Further, examples of drugs that may be co-administered with the subject anti-ACTH antibodies or antibody fragments or in the same therapeutic regimen include without limitation thereto one or more of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), or Zestril (lisinopril). Further exemplary active agents include one or more corticosteroids, including glucocorticoids and/or mineralocorticoids (including agents having one or both of glucocorticoid and/or mineralocorticoid activity), such as cortisol (hydrocortisone), dexamethasone, cortisone, prednisone, prednisolone, methylprednisolone, betamethasone, triamcinolone, beclometasone, fludrocortisone (e.g., fludrocortisone acetate), deoxycorticosterone (e.g., deoxycorticosterone acetate (DOCA)), and/or aldosterone.

It should also be noted that the anti-ACTH antibodies or antibody fragments of the present invention may be used in conjunction with any of the described non-pharmaceutical based therapies for sleep apnea. Accordingly, in one embodiment, the anti-ACTH antibodies or antibody fragments are used in combination with one or more of lifestyle changes, supplemental oxygen, medical devices, and surgery to treat sleep apnea.

The invention further relates to compositions containing the subject anti-ACTH antibodies or antibody fragments, especially compositions are suitable for in vivo administration, e.g., subcutaneous, intravenous, intradermal, intranasal, intrathecal, vaginal, rectal, and other injectable administrable dosage forms.

More specifically, the invention provides compositions containing the subject anti-ACTH antibodies or antibody fragments, especially compositions which are suitable for in vivo administration, e.g., subcutaneous, intravenous, intradermal, intranasal, intrathecal, vaginal, rectal, oral and other injectable dosage forms which optionally may contain another active agent such as ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®), and other drugs used to treat conditions wherein the treated individual may have elevated ACTH levels. Further examples of other active agent(s) that may optionally be contained in said dosage form include without limitation thereto one or more of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (MetopironeR), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), or Zestril (lisinopril). Further exemplary active agents include one or more corticosteroids, including glucocorticoids and/or mineralocorticoids (including agents having one or both of glucocorticoid and/or mineralocorticoid activity), such as cortisol (hydrocortisone), dexamethasone, cortisone, prednisone, prednisolone, methylprednisolone, betamethasone, triamcinolone, beclometasone, fludrocortisone (e.g., fludrocortisone acetate), deoxycorticosterone (e.g., deoxycorticosterone acetate (DOCA)), and/or aldosterone.

The invention also provides novel dosage regimens using the subject anti-ACTH antibodies or antibody fragments, alone or in association with another active, especially subcutaneous, oral and intravenous dosing regimens.

Other uses for the antibodies or antibody fragments according to the invention include, for example, diagnosis of ACTH-associated diseases or conditions and screening assays to determine the presence or absence of ACTH. Some of the antibodies or antibody fragments according to the invention described herein are useful in treating consequences, symptoms, and/or the pathology associated with ACTH activity.

Exemplary anti-ACTH antibodies and antibody fragments according to the invention, and the specific CDRs thereof are identified in the following section. For the reader's convenience, each exemplified antibody or fragment, and sequences contained therein, are separately described under a Header that identifies the exemplified antibody by a specific nomenclature, i.e., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H.

Antibody Polypeptide Sequences
Antibody Ab13

In one embodiment, the invention includes antibodies and antibody fragments having binding specificity to ACTH that possess a heavy chain sequence comprising the sequence set forth below:

(SEQ ID NO: 1)
QQLEESGGGLVKPGGTLTLTCTASGFSFSSGYDICWARQGPGKGLEWIGC

IDTGSGNTYYASWAKGRFTMSRTSSTTVTLQVTSLTAADTATYFCAKGIS

SIWGPGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 2)
QQLEESGGGLVKPGGTLTLTCTASGFSFSSGYDICWARQGPGKGLEWIGC

IDTGSGNTYYASWAKGRFTMSRTSSTTVTLQVTSLTAADTATYFCAKGIS

SIWGPGTLVTVSS.

In another embodiment, the invention includes antibodies and antibody fragments having binding specificity to ACTH that possess the same epitopic specificity as Ab13 and which contain a constant heavy chain sequence comprising the sequence set forth below:

(SEQ ID NO: 10)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

SEQ ID NO: 21)
DIVMTQTPASVSEPVGGTVTIKCQASQTISSDLAWYQQKPGQPPKLLIYA

ASKLTSGVSSRFKGGGTGTQFTLTISDLECADAATYYCQTYYDIIDDGCT

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to ACTH that contain a variable light chain sequence comprising the sequence set forth below:

```
                                                       (SEQ ID NO: 22)
DIVMTQTPASVSEPVGGTVTIKCQASQTISSDLAWYQQKPGQPPKLLIYA

ASKLTSGVSSRFKGGGTGTQFTLTISDLECADAATYYCQTYYDIIDDGCT

FGGGTEVVVKR.
```

In another embodiment, the invention includes antibodies and antibody fragments having binding specificity to ACTH that bind the same epitope as Ab13 which contain a constant light chain sequence comprising the sequence set forth below:

```
                                                       (SEQ ID NO: 30)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to ACTH that contain one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or which contain the variable heavy chain sequence of SEQ ID NO: 2, and/or which further contain one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or which contain the variable light chain sequence of SEQ ID NO: 22, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2, and/or one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 1 or SEQ ID NO: 2 or polypeptides that are at least 90% or 95% identical thereto. In another embodiment of the invention, the antibody or antibody fragments of the invention comprise, or alternatively consist of, the polypeptide sequence of SEQ ID NO: 21 or SEQ ID NO: 22 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or the variable heavy chain sequence of SEQ ID NO: 2 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or the variable light chain sequence of SEQ ID NO: 22 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 2; the variable light chain region of SEQ ID NO: 22; the complementarity-determining regions (SEQ ID NO: 4; SEQ ID NO: 6; and SEQ ID NO: 8) of the variable heavy chain region of SEQ ID NO: 2; and the complementarity-determining regions (SEQ ID NO: 24; SEQ ID NO: 26; and SEQ ID NO: 28) of the variable light chain region of SEQ ID NO: 22 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two three or more, including all of the following antibody fragments: the variable heavy chain region of SEQ ID NO: 2; the variable light chain region of SEQ ID NO: 22; the framework regions (SEQ ID NO: 3; SEQ ID NO: 5; SEQ ID NO: 7; and SEQ ID NO: 9) of the variable heavy chain region of SEQ ID NO: 2; and the framework regions (SEQ ID NO: 23; SEQ ID NO: 25; SEQ ID NO: 27; and SEQ ID NO: 29) of the variable light chain region of SEQ ID NO: 22.

In a particularly preferred embodiment of the invention, the anti-ACTH antibody is Ab13, comprising, or alternatively consisting of, SEQ ID NO: 1 and SEQ ID NO: 21 or SEQ ID NO: 2 and SEQ ID NO: 22, or an antibody or antibody fragment comprising the CDRs of Ab13 and having at least one of the biological activities set forth herein or is an anti-ACTH antibody that competes with Ab13 in binding ACTH, preferably one containing sequences that are at least 90%, 95%, 96%, 97%, 98% or 99% identical to that of Ab13 or an antibody that binds to the same or overlapping epitope(s) on ACTH as Ab13.

In a further particularly preferred embodiment of the invention, antibody fragments comprise, or alternatively consist of, Fab (fragment antigen binding) fragments having binding specificity for ACTH. With respect to antibody Ab13, the Fab fragment preferably includes the variable heavy chain sequence of SEQ ID NO: 2 and the variable light chain sequence of SEQ ID NO: 22 or sequences that are at least 90%, 95%, 96%, 97%, 98% or 99% identical thereto. This embodiment of the invention further includes Fabs containing additions, deletions, and variants of SEQ ID NO: 2 and/or SEQ ID NO: 22 which retain the binding specificity for ACTH.

In one embodiment of the invention described herein (infra), Fab fragments may be produced by enzymatic digestion (e.g., papain) of Ab13. In another embodiment of the invention, anti-ACTH antibodies such as Ab13 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab13 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab15

In one embodiment, the invention includes antibodies and antibody fragments having binding specificity to ACTH that possess a heavy chain sequence comprising the sequence set forth below:

```
                                          (SEQ ID NO: 41)
QQQLEESGGGLVKPGGTLTLTCKGSGIAFSDTYDMCWVRQAPGKGLEWIG

CIDTGSGDTYYPTWAKGRFTISKPSSTTVDLKMTSLTAADTATYFCAKGV

SSLWGQGTLVTVSSASTKGPSVFPLAPSSKSTSGGTAALGCLVKDYFPEP

VTVSWNSGALTSGVHTFPAVLQSSGLYSLSSVVTVPSSSLGTQTYICNVN

HKPSNTKVDARVEPKSCDKTHTCPPCPAPELLGGPSVFLFPPKPKDTLMI

SRTPEVTCVVVDVSHEDPEVKFNWYVDGVEVHNAKTKPREEQYASTYRVV

-continued
SVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGS

FFLYSKLTVDKSRWQQGNVFSCSVMHEALHNHYTQKSLSLSPGK.
```

In one embodiment, the invention includes antibodies and antibody fragments having binding specificity to ACTH that contain a variable heavy chain sequence comprising the sequence set forth below:

```
                                          (SEQ ID NO: 42)
QQQLEESGGGLVKPGGTLTLTCKGSGIAFSDTYDMCWVRQAPGKGLEWIG

CIDTGSGDTYYPTWAKGRFTISKPSSTTVDLKMTSLTAADTATYFCAKGV

SSLWGQGTLVTVSS.
```

In another embodiment, the invention includes antibodies and antibody fragments having binding specificity to ACTH that possess the same epitopic specificity as Ab15 and which contain a constant heavy chain sequence comprising the sequence set forth below:

```
                                          (SEQ ID NO: 50)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to ACTH that contain a light chain sequence comprising the sequence set forth below:

```
                                          (SEQ ID NO: 61)
DIVMTQTPASVSEPVGGTVTIKCQASEDIESDLAWYQQKPGQPPKLLIYG

ASTLKSGVSSRFRGSGSGTEYTLTISDLECADAATYYCQTYYDMADDGCS

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to ACTH that contain a variable light chain sequence comprising the sequence set forth below:

```
                                          (SEQ ID NO: 62)
DIVMTQTPASVSEPVGGTVTIKCQASEDIESDLAWYQQKPGQPPKLLIYG

ASTLKSGVSSRFRGSGSGTEYTLTISDLECADAATYYCQTYYDMADDGCS

FGGGTEVVVKR.
```

In another embodiment, the invention includes antibodies and antibody fragments having binding specificity to ACTH that bind the same epitope as Ab15 which contain a constant light chain sequence comprising the sequence set forth below:

(SEQ ID NO: 70)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or which contain the variable heavy chain sequence of SEQ ID NO: 42, and/or which further contain one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or which contain the variable light chain sequence of SEQ ID NO: 62, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42, and/or one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 41 or SEQ ID NO: 42 or polypeptides that are at least 90% or 95% identical thereto. In another embodiment of the invention, the antibody or antibody fragments of the invention comprise, or alternatively consist of, the polypeptide sequence of SEQ ID NO: 61 or SEQ ID NO: 62 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or the variable heavy chain sequence of SEQ ID NO: 42 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or the variable light chain sequence of SEQ ID NO: 62 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 42; the variable light chain region of SEQ ID NO: 62; the complementarity-determining regions (SEQ ID NO: 44; SEQ ID NO: 46; and SEQ ID NO: 48) of the variable heavy chain region of SEQ ID NO: 42; and the complementarity-determining regions (SEQ ID NO: 64; SEQ ID NO: 66; and SEQ ID NO: 68) of the variable light chain region of SEQ ID NO: 62 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 42; the variable light chain region of SEQ ID NO: 62; the framework regions (SEQ ID NO: 43; SEQ ID NO: 45; SEQ ID NO: 47; and SEQ ID NO: 49) of the variable heavy chain region of SEQ ID NO: 42; and the framework regions (SEQ ID NO: 63; SEQ ID NO: 65; SEQ ID NO: 67; and SEQ ID NO: 69) of the variable light chain region of SEQ ID NO: 62.

In a particularly preferred embodiment of the invention, the anti-ACTH antibody is Ab15, comprising, or alternatively consisting of, SEQ ID NO: 41 and SEQ ID NO: 61 or SEQ ID NO: 42 and SEQ ID NO: 62, or an antibody or antibody fragment comprising the CDRs of Ab15 and having at least one of the biological activities set forth herein or is an anti-ACTH antibody that competes with Ab15 in binding ACTH, preferably one containing sequences that are at least 90%, 95%, 96%, 97%, 98% or 99% identical to that of Ab15 or an antibody that binds to the same or overlapping epitope(s) on ACTH as Ab15.

In a further particularly preferred embodiment of the invention, antibody fragments comprise, or alternatively consist of, Fab (fragment antigen binding) fragments having binding specificity for ACTH. With respect to antibody Ab15, the Fab fragment preferably includes the variable heavy chain sequence of SEQ ID NO: 42 and the variable light chain sequence of SEQ ID NO: 62 or sequences that are at least 90%, 95%, 96%, 97%, 98% or 99% identical thereto. This embodiment of the invention further includes Fabs containing additions, deletions, and variants of SEQ ID NO: 42 and/or SEQ ID NO: 62 which retain the binding specificity for ACTH.

In one embodiment of the invention described herein (infra), Fab fragments may be produced by enzymatic digestion (e.g., papain) of Ab15. In another embodiment of the invention, anti-ACTH antibodies such as Ab15 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab15 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab17

In one embodiment, the invention includes antibodies and antibody fragments having binding specificity to ACTH that possess a heavy chain sequence comprising the sequence set forth below:

(SEQ ID NO: 81)
QQQLEESGGGLVKPGGTLTLTCKASGFSFSSGYDICWARQGPGKGLEWIG

CIDTGSGNTYYASWAKGRFTISRTSSTTVTLQMTSLTAADTATYFCAKGI

SSLWGPGTLVTVSSASTKGPSVFPLAPSSKSTSGGTAALGCLVKDYFPEP

VTVSWNSGALTSGVHTFPAVLQSSGLYSLSSVVTVPSSSLGTQTYICNVN

HKPSNTKVDARVEPKSCDKTHTCPPCPAPELLGGPSVFLFPPKPKDTLMI

SRTPEVTCVVVDVSHEDPEVKFNWYVDGVEVHNAKTKPREEQYASTYRVV

SVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGS

FFLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 82)
QQQLEESGGGLVKPGGTLTLTCKASGFSFSSGYDICWARQGPGKGLEWIG

CIDTGSGNTYYASWAKGRFTISRTSSTTVTLQMTSLTAADTATYFCAKGI

SSLWGPGTLVTVSS.

In another embodiment, the invention includes antibodies and antibody fragments having binding specificity to ACTH that possess the same epitopic specificity as Ab17 and which contain a constant heavy chain sequence comprising the sequence set forth below:

(SEQ ID NO: 90)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 101)
DIVMTQTPASVSEPVGGTVTIKCQASQTISSDLAWYQQKPGQPPKLLIYA

ASKLTSGVSSRFKGGGTGTQFTLTISDLECADAATYYCQTYYDISDDGCT

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to ACTH that contain a variable light chain sequence comprising the sequence set forth below:

(SEQ ID NO: 102)
DIVMTQTPASVSEPVGGTVTIKCQASQTISSDLAWYQQKPGQPPKLLIYA

ASKLTSGVSSRFKGGGTGTQFTLTISDLECADAATYYCQTYYDISDDGCT

FGGGTEVVVKR.

In another embodiment, the invention includes antibodies and antibody fragments having binding specificity to ACTH that bind the same epitope as Ab17 which contain a constant light chain sequence comprising the sequence set forth below:

(SEQ ID NO: 110)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or which contain the variable heavy chain sequence of SEQ ID NO: 82, and/or which further contain one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or which contain the variable light chain sequence of SEQ ID NO: 102, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82, and/or one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 81 or SEQ ID NO: 82 or polypeptides that are at least 90% or 95% identical thereto. In another embodiment of the invention, the antibody or antibody fragments of the invention comprise, or alternatively consist of, the polypeptide sequence of SEQ ID NO: 101 or SEQ ID NO: 102 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or the variable heavy chain sequence of SEQ ID NO: 82 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or the variable light chain sequence of SEQ ID NO: 102 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 82; the variable light chain region of SEQ ID NO: 102; the complementarity-determining regions (SEQ ID NO: 84; SEQ ID NO: 86; and SEQ ID NO: 88) of the variable heavy chain region of SEQ ID NO: 82; and the complementarity-determining regions (SEQ ID NO: 104; SEQ ID NO: 106; and SEQ ID NO: 108) of the variable light chain region of SEQ ID NO: 102 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 82; the variable light chain region of SEQ ID NO: 102; the framework regions (SEQ ID NO: 83; SEQ ID NO: 85; SEQ ID NO: 87; and SEQ ID NO: 89) of the variable heavy chain region of SEQ ID NO: 82; and the framework regions (SEQ ID NO: 103; SEQ ID NO: 105; SEQ ID NO: 107; and SEQ ID NO: 109) of the variable light chain region of SEQ ID NO: 102.

In a particularly preferred embodiment of the invention, the anti-ACTH antibody is Ab17, comprising, or alternatively consisting of, SEQ ID NO: 81 and SEQ ID NO: 101 or SEQ ID NO: 82 and SEQ ID NO: 102, or an antibody or antibody fragment comprising the CDRs of Ab17 and having at least one of the biological activities set forth herein or is an anti-ACTH antibody that competes with Ab17 in binding ACTH, preferably one containing sequences that are at least 90%, 95%, 96%, 97%, 98% or 99% identical to that of Ab17 or an antibody that binds to the same or overlapping epitope(s) on ACTH as Ab17.

In a further particularly preferred embodiment of the invention, antibody fragments comprise, or alternatively consist of, Fab (fragment antigen binding) fragments having binding specificity for ACTH. With respect to antibody Ab17, the Fab fragment preferably includes the variable heavy chain sequence of SEQ ID NO: 82 and the variable light chain sequence of SEQ ID NO: 102 or sequences that are at least 90%, 95%, 96%, 97%, 98% or 99% identical thereto. This embodiment of the invention further includes Fabs containing additions, deletions, and variants of SEQ ID NO: 82 and/or SEQ ID NO: 102 which retain the binding specificity for ACTH.

In one embodiment of the invention described herein (infra), Fab fragments may be produced by enzymatic digestion (e.g., papain) of Ab17. In another embodiment of the invention, anti-ACTH antibodies such as Ab17 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab17 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab1.H

In one embodiment, the invention includes antibodies and antibody fragments having binding specificity to ACTH that possess a heavy chain sequence comprising the sequence set forth below:

(SEQ ID NO: 121)
EVQLVESGGGLVQPGGSLRLSCAASGFTVSNYDMIWVRQAPGKGLESIGM

IYDDGDTYYASSAKGRFTISRDNSKNTLYLQMNSLRAEDTAVYYCVKGVS

NHWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 122)
EVQLVESGGGLVQPGGSLRLSCAASGFTVSNYDMIWVRQAPGKGLESIGM

IYDDGDTYYASSAKGRFTISRDNSKNTLYLQMNSLRAEDTAVYYCVKGVS

NHWGQGTLVTVSS.

In another embodiment, the invention includes antibodies and antibody fragments having binding specificity to ACTH that possess the same epitopic specificity as Ab1.H and which contain a constant heavy chain sequence comprising the sequence set forth below:

(SEQ ID NO: 130)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 141)
DIQMTQSPSTLSASVGDRVTITCQASQSISSYLAWYQQKPGKAPKLLIYS

ASTLASGVPSRFSGSGSGTEFTLTISSLQPDDFATYYCQSYDGSSGSSYG

VGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 142)
DIQMTQSPSTLSASVGDRVTITCQASQSISSYLAWYQQKPGKAPKLLIYS

ASTLASGVPSRFSGSGSGTEFTLTISSLQPDDFATYYCQSYDGSSGSSYG

VGFGGGTKVEIKR.

In another embodiment, the invention includes antibodies and antibody fragments having binding specificity to ACTH that bind the same epitope as Ab1.H which contain a constant light chain sequence comprising the sequence set forth below:

(SEQ ID NO: 150)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or which contain the variable heavy chain sequence of SEQ ID NO: 122, and/or which further contain one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or which contain the variable light chain sequence of SEQ ID NO: 142, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122, and/or one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 121 or SEQ ID NO: 122 or polypeptides that are at least 90% or 95% identical thereto. In another embodiment of the invention, the antibody or antibody fragments of the invention comprise, or alternatively consist of, the polypeptide sequence of SEQ ID NO: 141 or SEQ ID NO: 142 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or the variable heavy chain sequence of SEQ ID NO: 122 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or the variable light chain sequence of SEQ ID NO: 142 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 122; the variable light chain region of SEQ ID NO: 142; the complementarity-determining regions (SEQ ID NO: 124; SEQ ID NO: 126; and SEQ ID NO: 128) of the variable heavy chain region of SEQ ID NO: 122; and the complementarity-determining regions (SEQ ID NO: 144; SEQ ID NO: 146; and SEQ ID NO: 148) of the variable light chain region of SEQ ID NO: 142 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 122; the variable light chain region of SEQ ID NO: 142; the framework regions (SEQ ID NO: 123; SEQ ID NO: 125; SEQ ID NO: 127; and SEQ ID NO: 129) of the variable heavy chain region of SEQ ID NO: 122; and the framework regions (SEQ ID NO: 143; SEQ ID NO: 145; SEQ ID NO: 147; and SEQ ID NO: 149) of the variable light chain region of SEQ ID NO: 142.

In a particularly preferred embodiment of the invention, the anti-ACTH antibody is Ab1.H, comprising, or alternatively consisting of, SEQ ID NO: 121 and SEQ ID NO: 141 or SEQ ID NO: 122 and SEQ ID NO: 142, or an antibody or antibody fragment comprising the CDRs of Ab1.H and having at least one of the biological activities set forth herein or is an anti-ACTH antibody that competes with Ab1.H in binding ACTH, preferably one containing sequences that are at least 90%, 95%, 96%, 97%, 98% or 99% identical to that of Ab1.H or an antibody that binds to the same or overlapping epitope(s) on ACTH as Ab1.H.

In a further particularly preferred embodiment of the invention, antibody fragments comprise, or alternatively consist of, Fab (fragment antigen binding) fragments having binding specificity for ACTH. With respect to antibody Ab1.H, the Fab fragment preferably includes the variable heavy chain sequence of SEQ ID NO: 122 and the variable light chain sequence of SEQ ID NO: 142 or sequences that are at least 90%, 95%, 96%, 97%, 98% or 99% identical thereto. This embodiment of the invention further includes Fabs containing additions, deletions, and variants of SEQ ID NO: 122 and/or SEQ ID NO: 142 which retain the binding specificity for ACTH.

In one embodiment of the invention described herein (infra), Fab fragments may be produced by enzymatic digestion (e.g., papain) of Ab1.H. In another embodiment of the invention, anti-ACTH antibodies such as Ab1.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab1.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab2.H

In one embodiment, the invention includes antibodies and antibody fragments having binding specificity to ACTH that possess a heavy chain sequence comprising the sequence set forth below:

```
                                          (SEQ ID NO: 161)
EVQLVESGGGLVQPGGSLRLSCAASGFTVSKYDMIWVRQAPGKGLESIGI

IYDDGDTYYASSAKGRFTISRDNSKNTLYLQMNSLRAEDTAVYYCVKGVS

NIWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.
```

In one embodiment, the invention includes antibodies and antibody fragments having binding specificity to ACTH that contain a variable heavy chain sequence comprising the sequence set forth below:

```
                                          (SEQ ID NO: 162)
EVQLVESGGGLVQPGGSLRLSCAASGFTVSKYDMIWVRQAPGKGLESIGI

IYDDGDTYYASSAKGRFTISRDNSKNTLYLQMNSLRAEDTAVYYCVKGVS

NIWGQGTLVTVSS.
```

In another embodiment, the invention includes antibodies and antibody fragments having binding specificity to ACTH that possess the same epitopic specificity as Ab2.H and which contain constant heavy chain sequence comprising the sequence set forth below:

```
                                          (SEQ ID NO: 170)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to ACTH that contain a light chain sequence comprising the sequence set forth below:

```
                                          (SEQ ID NO: 181)
DIQMTQSPSTLSASVGDRVTITCQASQSISNYLAWYQQKPGKAPKLLIYS

ASTLASGVPSRFSGSGSGTEFTLTISSLQPDDFATYYCQSYEGSSSSSYG

VGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.
```

In another embodiment, the invention includes antibodies and antibody fragments having binding specificity to ACTH that contain a variable light chain sequence comprising the sequence set forth below:

```
                                          (SEQ ID NO: 182)
DIQMTQSPSTLSASVGDRVTITCQASQSISNYLAWYQQKPGKAPKLLIYS

ASTLASGVPSRFSGSGSGTEFTLTISSLQPDDFATYYCQSYEGSSSSSYG

VGFGGGTKVEIKR.
```

In another embodiment, the invention includes antibodies and antibody fragments having binding specificity to ACTH that bind the same epitope as Ab2.H which contain a constant light chain sequence comprising the sequence set forth below:

```
                                          (SEQ ID NO: 190)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to ACTH that contain one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or which contain the variable heavy chain sequence of SEQ ID NO: 162, and/or which further contain one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or which contain the variable light chain sequence of SEQ ID NO: 182, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162, and/or one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 161 or SEQ ID NO: 162 or polypeptides that are at least 90% or 95% identical thereto. In another embodiment of the invention, the antibody or antibody fragments of the invention comprise, or alternatively consist of, the polypeptide sequence of SEQ ID NO: 181 or SEQ ID NO: 182 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or the variable heavy chain sequence of SEQ ID NO: 162 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or the variable light chain sequence of SEQ ID NO: 182 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 162; the variable light chain region of SEQ ID NO: 182; the complementarity-determining regions (SEQ ID NO: 164; SEQ ID NO: 166; and SEQ ID NO: 168) of the variable heavy chain region of SEQ ID NO: 162; and the complementarity-determining regions (SEQ ID NO: 184; SEQ ID NO: 186; and SEQ ID NO: 188) of the variable light chain region of SEQ ID NO: 182 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 162; the variable light chain region of SEQ ID NO: 182; the framework regions (SEQ ID NO: 163; SEQ ID NO: 165; SEQ ID NO: 167; and SEQ ID NO: 169) of the variable heavy chain region of SEQ ID NO: 162; and the framework regions (SEQ ID NO: 183; SEQ ID NO: 185; SEQ ID NO: 187; and SEQ ID NO: 189) of the variable light chain region of SEQ ID NO: 182.

In a particularly preferred embodiment of the invention, the anti-ACTH antibody is Ab2.H, comprising, or alternatively consisting of, SEQ ID NO: 161 and SEQ ID NO: 181 or SEQ ID NO: 162 and SEQ ID NO: 182, or an antibody or antibody fragment comprising the CDRs of Ab2.H and having at least one of the biological activities set forth herein or is an anti-ACTH antibody that competes with Ab2.H in binding ACTH, preferably one containing sequences that are at least 90%, 95%, 96%, 97%, 98% or 99% identical to that of Ab2.H or an antibody that binds to the same or overlapping epitope(s) on ACTH as Ab2.H.

In a further particularly preferred embodiment of the invention, antibody fragments comprise, or alternatively consist of, Fab (fragment antigen binding) fragments having binding specificity for ACTH. With respect to antibody Ab2.H, the Fab fragment preferably includes the variable heavy chain sequence of SEQ ID NO: 162 and the variable light chain sequence of SEQ ID NO: 182 or sequences that are at least 90%, 95%, 96%, 97%, 98% or 99% identical thereto. This embodiment of the invention further includes Fabs containing additions, deletions, and variants of SEQ ID NO: 162 and/or SEQ ID NO: 182 which retain the binding specificity for ACTH.

In one embodiment of the invention described herein (infra), Fab fragments may be produced by enzymatic digestion (e.g., papain) of Ab2.H. In another embodiment of the invention, anti-ACTH antibodies such as Ab2.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab2.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab3.H

In one embodiment, the invention includes antibodies and antibody fragments having binding specificity to ACTH that possess a heavy chain sequence comprising the sequence set forth below:

(SEQ ID NO: 201)
EVQLVESGGGLVQPGGSLRLSCAASGSSLSNFDMIWVRQAPGKGLESIGI

IYDFGSTYYASSAKGRFTISRDNSKNTLYLQMNSLRAEDTAVYYCVKGVS

NIWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 202)
EVQLVESGGGLVQPGGSLRLSCAASGSSLSNFDMIWVRQAPGKGLESIGI

IYDFGSTYYASSAKGRFTISRDNSKNTLYLQMNSLRAEDTAVYYCVKGVS

NIWGQGTLVTVSS.

In another embodiment, the invention includes antibodies and antibody fragments having binding specificity to ACTH that possess the same epitopic specificity as Ab3.H and which contain a constant heavy chain sequence comprising the sequence set forth below:

(SEQ ID NO: 210)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 221)
DIQMTQSPSTLSASVGDRVTITCQASEDISSNLAWYQQKPGKAPKLLIYS

ASTLASGVPSRFSGSGSGTEFTLTISSLQPDDFATYYCQSYDGSSSSSYG

IGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 222)
DIQMTQSPSTLSASVGDRVTITCQASEDISSNLAWYQQKPGKAPKLLIYS

ASTLASGVPSRFSGSGSGTEFTLTISSLQPDDFATYYCQSYDGSSSSSYG

IGFGGGTKVEIKR.

In another embodiment, the invention includes antibodies and antibody fragments having binding specificity to ACTH that bind the same epitope as Ab3.H which contain a constant light chain sequence comprising the sequence set forth below:

(SEQ ID NO: 230)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 204; SEQ ID NO: 206; and SEQ ID NO: 208 which correspond to the complementarity-determining regions (CDRs, or hypervariable regions) of the heavy chain sequence of SEQ ID NO: 201 or which contain the variable heavy chain sequence of SEQ ID NO: 202, and/or which further contain one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or which contain the variable light chain sequence of SEQ ID NO: 222, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202, and/or one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 201 or SEQ ID NO: 202 or polypeptides that are at least 90% or 95% identical thereto. In another embodiment of the invention, the antibody or antibody fragments of the invention comprise, or alternatively consist of, the polypeptide sequence of SEQ ID NO: 221 or SEQ ID NO: 222 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 204; SEQ ID NO: 206; and SEQ ID NO: 208 which correspond to the complementarity-determining regions (CDRs, or hypervariable regions) of the heavy chain sequence of SEQ ID NO: 201 or the variable heavy chain sequence of SEQ ID NO: 202 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or the variable light chain sequence of SEQ ID NO: 222 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 202; the variable light chain region of SEQ ID NO: 222; the complementarity-determining regions (SEQ ID NO: 204; SEQ ID NO: 206; and SEQ ID NO: 208) of the variable heavy chain region of SEQ ID NO: 202; and the complementarity-determining regions (SEQ ID NO: 224; SEQ ID NO: 226; and SEQ ID NO: 228) of the variable light chain region of SEQ ID NO: 222 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 202; the variable light chain region of SEQ ID NO: 222; the framework regions (SEQ ID NO: 203; SEQ ID NO: 205; SEQ ID NO: 207; and SEQ ID NO: 209) of the variable heavy chain region of SEQ ID NO: 202; and the framework regions (SEQ ID NO: 223; SEQ ID NO: 225; SEQ ID NO: 227; and SEQ ID NO: 229) of the variable light chain region of SEQ ID NO: 222.

In a particularly preferred embodiment of the invention, the anti-ACTH antibody is Ab3.H, comprising, or alternatively consisting of, SEQ ID NO: 201 and SEQ ID NO: 221 or SEQ ID NO: 202 and SEQ ID NO: 222, or an antibody or antibody fragment comprising the CDRs of Ab3.H and having at least one of the biological activities set forth herein or is an anti-ACTH antibody that competes with Ab3.H in binding ACTH, preferably one containing sequences that are at least 90%, 95%, 96%, 97%, 98% or 99% identical to that of Ab3.H or an antibody that binds to the same or overlapping epitope(s) on ACTH as Ab3.H.

In a further particularly preferred embodiment of the invention, antibody fragments comprise, or alternatively consist of, Fab (fragment antigen binding) fragments having binding specificity for ACTH. With respect to antibody Ab3.H, the Fab fragment preferably includes the variable heavy chain sequence of SEQ ID NO: 202 and the variable light chain sequence of SEQ ID NO: 222 or sequences that are at least 90%, 95%, 96%, 97%, 98% or 99% identical thereto. This embodiment of the invention further includes Fabs containing additions, deletions, and variants of SEQ ID NO: 202 and/or SEQ ID NO: 222 which retain the binding specificity for ACTH.

In one embodiment of the invention described herein (infra), Fab fragments may be produced by enzymatic digestion (e.g., papain) of Ab3.H. In another embodiment of the invention, anti-ACTH antibodies such as Ab3.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab3.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab4.H

In one embodiment, the invention includes antibodies and antibody fragments having binding specificity to ACTH that possess a heavy chain sequence comprising the sequence set forth below:

(SEQ ID NO: 241)
EVQLVESGGGLVQPGGSLRLSCAASGFTVSKHDMIWVRQAPGKGLESIGI

IYDDGDTYYANSAKGRFTISRDNSKNTLYLQMNSLRAEDTAVYYCVKGVS

NIWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 242)
EVQLVESGGGLVQPGGSLRLSCAASGFTVSKHDMIWVRQAPGKGLESIGI

IYDDGDTYYANSAKGRFTISRDNSKNTLYLQMNSLRAEDTAVYYCVKGVS

NIWGQGTLVTVSS.

In another embodiment, the invention includes antibodies and antibody fragments having binding specificity to ACTH that possess the same epitopic specificity as Ab4.H and which contain a constant heavy chain sequence comprising the sequence set forth below:

(SEQ ID NO: 250)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 261)
DIQMTQSPSTLSASVGDRVTITCRASQSISVYLAWYQQKPGKAPKLLIYQ

ASKLASGVPSRFSGSGSGTEFTLTISSLQPDDFATYYCQSYDGSSSSSYG

VGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 262)
DIQMTQSPSTLSASVGDRVTITCRASQSISVYLAWYQQKPGKAPKLLIYQ

ASKLASGVPSRFSGSGSGTEFTLTISSLQPDDFATYYCQSYDGSSSSSYG

VGFGGGTKVEIKR.

In another embodiment, the invention includes antibodies and antibody fragments having binding specificity to ACTH that bind the same epitope as Ab4.H which contain a constant light chain sequence comprising the sequence set forth below:

(SEQ ID NO: 270)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or which contain the variable heavy chain sequence of SEQ ID NO: 242, and/or which further contain one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or which contain the variable light chain sequence of SEQ ID NO: 262, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242, and/or one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 241 or SEQ ID NO: 242 or polypeptides that are at least 90% or 95% identical thereto. In another embodiment of the invention, the antibody or antibody fragments of the invention comprise, or alternatively consist of, the polypeptide sequence of SEQ ID NO: 261 or SEQ ID NO: 262 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or the variable heavy chain sequence of SEQ ID NO: 242 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or the variable light chain sequence of SEQ ID NO: 262 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 242; the variable light chain region of SEQ ID NO: 262; the complementarity-determining regions (SEQ ID NO: 244; SEQ ID NO: 246; and SEQ ID NO: 248) of the variable heavy chain region of SEQ ID NO: 242; and the complementarity-determining regions (SEQ ID NO: 264; SEQ ID NO: 266; and SEQ ID NO: 268) of the variable light chain region of SEQ ID NO: 262 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 242; the variable light chain region of SEQ ID NO: 262; the framework regions (SEQ ID NO: 243; SEQ ID NO: 245; SEQ ID NO: 247; and SEQ ID NO: 249) of the variable heavy chain region of SEQ ID NO: 242; and the framework regions (SEQ ID NO: 263; SEQ ID NO: 265; SEQ ID NO: 267; and SEQ ID NO: 269) of the variable light chain region of SEQ ID NO: 262.

In a particularly preferred embodiment of the invention, the anti-ACTH antibody is Ab4.H, comprising, or alternatively consisting of, SEQ ID NO: 241 and SEQ ID NO: 261 or SEQ ID NO: 242 and SEQ ID NO: 262, or an antibody or antibody fragment comprising the CDRs of Ab4.H and having at least one of the biological activities set forth herein or is an anti-ACTH antibody that competes with Ab4.H in binding ACTH, preferably one containing sequences that are at least 90%, 95%, 96%, 97%, 98% or 99% identical to that of Ab4.H or an antibody that binds to the same or overlapping epitope(s) on ACTH as Ab4.H.

In a further particularly preferred embodiment of the invention, antibody fragments comprise, or alternatively consist of, Fab (fragment antigen binding) fragments having binding specificity for ACTH. With respect to antibody Ab4.H, the Fab fragment preferably includes the variable heavy chain sequence of SEQ ID NO: 242 and the variable light chain sequence of SEQ ID NO: 262 or sequences that are at least 90%, 95%, 96%, 97%, 98% or 99% identical thereto. This embodiment of the invention further includes Fabs containing additions, deletions, and variants of SEQ ID NO: 242 and/or SEQ ID NO: 262 which retain the binding specificity for ACTH.

In one embodiment of the invention described herein (infra), Fab fragments may be produced by enzymatic digestion (e.g., papain) of Ab4.H. In another embodiment of the invention, anti-ACTH antibodies such as Ab4.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab4.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab6.H

In one embodiment, the invention includes antibodies and antibody fragments having binding specificity to ACTH that possess a heavy chain sequence comprising the sequence set forth below:

(SEQ ID NO: 281)
EVQLVESGGGLVQPGGSLRLSCAASGFSLTDYAMSWVRQAPGKGLEWIGI

ISDSGSTYYASSAKGRFTISRDNSKNTLYLQMNSLRAEDTAVYYCAREPE

YGYDEYGDWVSDLWGQGTLVTVSSASTKGPSVFPLAPSSKSTSGGTAALG

CLVKDYFPEPVTVSWNSGALTSGVHTFPAVLQSSGLYSLSSVVTVPSSSL

GTQTYICNVNHKPSNTKVDARVEPKSCDKTHTCPPCPAPELLGGPSVFLF

PPKPKDTLMISRTPEVTCVVVDVSHEDPEVKFNWYVDGVEVHNAKTKPRE

EQYASTYRVVSVLTVLHQDWLNGKEYKCKVSNKALPAPIEKTISKAKGQP

-continued
REPQVYTLPPSREEMTKNQVSLTCLVKGFYPSDIAVEWESNGQPENNYKT

TPPVLDSDGSFFLYSKLTVDKSRWQQGNVFSCSVMHEALHNHYTQKSLSL

SPGK.

In one embodiment, the invention includes antibodies and antibody fragments having binding specificity to ACTH that contain a variable heavy chain sequence comprising the sequence set forth below:

(SEQ ID NO: 282)
EVQLVESGGGLVQPGGSLRLSCAASGFSLTDYAMSWVRQAPGKGLEWIGI

ISDSGSTYYASSAKGRFTISRDNSKNTLYLQMNSLRAEDTAVYYCAREPE

YGYDEYGDWVSDLWGQGTLVTVSS.

In another embodiment, the invention includes antibodies and antibody fragments having binding specificity to ACTH that possess the same epitopic specificity as Ab6.H and which contain a constant heavy chain sequence comprising the sequence set forth below:

(SEQ ID NO: 290)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 301)
DIQMTQSPSTLSASVGDRVTITCQATQSIGNNLAWYQQKPGKAPKLLIYR

ASTLASGVPSRFSGSGSGTEFTLTISSLQPDDFATYYCQSYYYSSSITYH

NAFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 302)
DIQMTQSPSTLSASVGDRVTITCQATQSIGNNLAWYQQKPGKAPKLLIYR

ASTLASGVPSRFSGSGSGTEFTLTISSLQPDDFATYYCQSYYYSSSITYH

NAFGGGTKVEIKR.

In another embodiment, the invention includes antibodies and antibody fragments having binding specificity to ACTH that bind the same epitope as Ab6.H which contain a constant light chain sequence comprising the sequence set forth below:

(SEQ ID NO: 310)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or which contain the variable heavy chain sequence of SEQ ID NO: 282, and/or which further contain one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or which contain the variable light chain sequence of SEQ ID NO: 302, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282, and/or one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 281 or SEQ ID NO: 282 or polypeptides that are at least 90% or 95% identical thereto. In another embodiment of the invention, the antibody or antibody fragments of the invention comprise, or alternatively consist of, the polypeptide sequence of SEQ ID NO: 301 or SEQ ID NO: 302 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or the variable heavy chain sequence of SEQ ID NO: 282 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or the variable light chain sequence of SEQ ID NO: 302 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 282; the variable light chain region of SEQ ID NO: 302; the complementarity-determining regions (SEQ ID NO: 284; SEQ ID NO: 286; and SEQ ID NO: 288) of the variable heavy chain region of SEQ ID NO: 282; and the complementarity-determining regions (SEQ ID NO: 304; SEQ ID NO: 306; and SEQ ID NO: 308) of the variable light chain region of SEQ ID NO: 302 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 282; the variable light chain region of SEQ ID NO: 302; the framework regions (SEQ ID NO: 283; SEQ ID NO: 285; SEQ ID NO: 287; and SEQ ID NO: 289) of the variable heavy chain region of SEQ ID NO: 282; and the framework regions (SEQ ID NO: 303; SEQ ID NO: 305; SEQ ID NO: 307; and SEQ ID NO: 309) of the variable light chain region of SEQ ID NO: 302.

In a particularly preferred embodiment of the invention, the anti-ACTH antibody is Ab6.H, comprising, or alternatively consisting of, SEQ ID NO: 281 and SEQ ID NO: 301 or SEQ ID NO: 282 and SEQ ID NO: 302, or an antibody or antibody fragment comprising the CDRs of Ab6.H and having at least one of the biological activities set forth herein or is an anti-ACTH antibody that competes with Ab6.H in binding ACTH, preferably one containing sequences that are at least 90%, 95%, 96%, 97%, 98% or 99% identical to that of Ab6.H or an antibody that binds to the same or overlapping epitope(s) on ACTH as Ab6.H.

In a further particularly preferred embodiment of the invention, antibody fragments comprise, or alternatively consist of, Fab (fragment antigen binding) fragments having binding specificity for ACTH. With respect to antibody Ab6.H, the Fab fragment preferably includes the variable heavy chain sequence of SEQ ID NO: 282 and the variable light chain sequence of SEQ ID NO: 302 or sequences that are at least 90%, 95%, 96%, 97%, 98% or 99% identical thereto. This embodiment of the invention further includes Fabs containing additions, deletions, and variants of SEQ ID NO: 282 and/or SEQ ID NO: 302 which retain the binding specificity for ACTH.

In one embodiment of the invention described herein (infra), Fab fragments may be produced by enzymatic digestion (e.g., papain) of Ab6.H. In another embodiment of the invention, anti-ACTH antibodies such as Ab6.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab6.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab7.H

In one embodiment, the invention includes antibodies and antibody fragments having binding specificity to ACTH that possess a heavy chain sequence comprising the sequence set forth below:

```
                                         (SEQ ID NO: 321)
EVQLVESGGGLVQPGGSLRLSCAASGFSLSSYAMSWVRQAPGKGLEWIGI

ISDSGSTYYASSAKGRFTISRDNSKNTLYLQMNSLRAEDTAVYYCAREPE

YGYDDYGDWVSDLWGQGTLVTVSSASTKGPSVFPLAPSSKSTSGGTAALG

CLVKDYFPEPVTVSWNSGALTSGVHTFPAVLQSSGLYSLSSVVTVPSSSL

GTQTYICNVNHKPSNTKVDARVEPKSCDKTHTCPPCPAPELLGGPSVFLF

PPKPKDTLMISRTPEVTCVVVDVSHEDPEVKFNWYVDGVEVHINAKTKPR

EEQYASTYRVVSVLTVLHQDWLNGKEYKCKVSNKALPAPIEKTISKAKGQ

PREPQVYTLPPSREEMTKNQVSLTCLVKGFYPSDIAVEWESNGQPENNYK

TTPPVLDSDGSFFLYSKLTVDKSRWQQGNVFSCSVMHEALHNHYTQKSLS

LSPGK.
```

In one embodiment, the invention includes antibodies and antibody fragments having binding specificity to ACTH that contain a variable heavy chain sequence comprising the sequence set forth below:

(SEQ ID NO: 322)
EVQLVESGGGLVQPGGSLRLSCAASGFSLSSYAMSWVRQAPGKGLEWIGI

ISDSGSTYYASSAKGRFTISRDNSKNTLYLQMNSLRAEDTAVYYCAREPE

YGYDDYGDWVSDLWGQGTLVTVSS.

In another embodiment, the invention includes antibodies and antibody fragments having binding specificity to ACTH that possess the same epitopic specificity as Ab7.H and which contain a constant heavy chain sequence comprising the sequence set forth below:

(SEQ ID NO: 330)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 341)
DIQMTQSPSTLSASVGDRVTITCQASQSISDYLSWYQQKPGKAPKLLIYR

ASTLASGVPSRFSGSGSGTEFTLTISSLQPDDFATYYCQSYYYSSSITYR

NAFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 342)
DIQMTQSPSTLSASVGDRVTITCQASQSISDYLSWYQQKPGKAPKLLIYR

ASTLASGVPSRFSGSGSGTEFTLTISSLQPDDFATYYCQSYYYSSSITYR

NAFGGGTKVEIKR.

In another embodiment, the invention includes antibodies and antibody fragments having binding specificity to ACTH that bind the same epitope as Ab7.H which contain a constant light chain sequence comprising the sequence set forth below:

(SEQ ID NO: 350)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or which contain the variable heavy chain sequence of SEQ ID NO: 322, and/or which further contain one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or which contain the variable light chain sequence of SEQ ID NO: 342, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322, and/or one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 321 or SEQ ID NO: 322 or polypeptides that are at least 90% or 95% identical thereto. In another embodiment of the invention, the antibody or antibody fragments of the invention comprise, or alternatively consist of, the polypeptide sequence of SEQ ID NO: 341 or SEQ ID NO: 342 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or the variable heavy chain sequence of SEQ ID NO: 322 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or the variable light chain sequence of SEQ ID NO: 342 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 322; the variable light chain region of SEQ ID NO: 342; the complementarity-determining regions (SEQ ID NO: 324; SEQ ID NO: 326; and SEQ ID NO: 328) of the variable heavy chain region of SEQ ID NO: 322; and the complementarity-determining regions (SEQ ID NO: 344; SEQ ID NO: 346; and SEQ ID NO: 348) of the variable light chain region of SEQ ID NO: 342 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 322; the variable light chain region of SEQ ID NO: 342; the framework regions (SEQ ID NO: 323; SEQ ID NO: 325; SEQ ID NO: 327; and SEQ ID NO: 329) of the variable heavy chain region of SEQ ID NO: 322; and the framework regions (SEQ ID NO: 343; SEQ ID NO: 345; SEQ ID NO: 347; and SEQ ID NO: 349) of the variable light chain region of SEQ ID NO: 342.

In a particularly preferred embodiment of the invention, the anti-ACTH antibody is Ab7.H, comprising, or alternatively consisting of, SEQ ID NO: 321 and SEQ ID NO: 341 or SEQ ID NO: 322 and SEQ ID NO: 342, or an antibody or antibody fragment comprising the CDRs of Ab7.H and having at least one of the biological activities set forth herein or is an anti-ACTH antibody that competes with Ab7.H in binding ACTH, preferably one containing sequences that are at least 90%, 95%, 96%, 97%, 98% or 99% identical to that of Ab7.H or an antibody that binds to the same or overlapping epitope(s) on ACTH as Ab7.H.

In a further particularly preferred embodiment of the invention, antibody fragments comprise, or alternatively consist of, Fab (fragment antigen binding) fragments having binding specificity for ACTH. With respect to antibody Ab7.H, the Fab fragment preferably includes the variable heavy chain sequence of SEQ ID NO: 322 and the variable light chain sequence of SEQ ID NO: 342 or sequences that are at least 90%, 95%, 96%, 97%, 98% or 99% identical thereto. This embodiment of the invention further includes Fabs containing additions, deletions, and variants of SEQ ID NO: 322 and/or SEQ ID NO: 342 which retain the binding specificity for ACTH.

In one embodiment of the invention described herein (infra), Fab fragments may be produced by enzymatic digestion (e.g., papain) of Ab7.H. In another embodiment of the invention, anti-ACTH antibodies such as Ab7.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab7.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab7A.H

In one embodiment, the invention includes antibodies and antibody fragments having binding specificity to ACTH that possess a heavy chain sequence comprising the sequence set forth below:

(SEQ ID NO: 361)
EVQLVESGGGLVQPGGSLRLSCAASGFSLSSYAMSWVRQAPGKGLEWIGI

ISDSGSTYYASSAKGRFTISRDNSKNTLYLQMNSLRAEDTAVYYCAREPE

YGYDDYGDWVSDLWGQGTLVTVSSASTKGPSVFPLAPSSKSTSGGTAALG

CLVKDYFPEPVTVSWNSGALTSGVHTFPAVLQSSGLYSLSSVVTVPSSSL

GTQTYICNVNHKPSNTKVDARVEPKSCDKTHTCPPCPAPELLGGPSVFLF

PPKPKDTLMISRTPEVTCVVVDVSHEDPEVKFNWYVDGVEVHNAKTKPRE

EQYASTYRVVSVLTVLHQDWLNGKEYKCKVSNKALPAPIEKTISKAKGQP

REPQVYTLPPSREEMTKNQVSLTCLVKGFYPSDIAVEWESNGQPENNYKT

TPPVLDSDGSFFLYSKLTVDKSRWQQGNVFSCSVMHEALHNHYTQKSLSL

SPGK.

In one embodiment, the invention includes antibodies and antibody fragments having binding specificity to ACTH that contain a variable heavy chain sequence comprising the sequence set forth below:

(SEQ ID NO: 362)
EVQLVESGGGLVQPGGSLRLSCAASGFSLSSYAMSWVRQAPGKGLEWIGI

ISDSGSTYYASSAKGRFTISRDNSKNTLYLQMNSLRAEDTAVYYCAREPE

YGYDDYGDWVSDLWGQGTLVTVSS.

In another embodiment, the invention includes antibodies and antibody fragments having binding specificity to ACTH that possess the same epitopic specificity as Ab7A.H and which contain a constant heavy chain sequence comprising the sequence set forth below:

(SEQ ID NO: 370)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 381)
ADIQMTQSPSTLSASVGDRVTITCQASQSISDYLSWYQQKPGKAPKLLIY

RASTLASGVPSRFSGSGSGTEFTLTISSLQPDDFATYYCQSYYYSSSITY

RNAFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYAC

EVTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 382)
ADIQMTQSPSTLSASVGDRVTITCQASQSISDYLSWYQQKPGKAPKLLIY

RASTLASGVPSRFSGSGSGTEFTLTISSLQPDDFATYYCQSYYYSSSITY

RNAFGGGTKVEIKR.

In another embodiment, the invention includes antibodies and antibody fragments having binding specificity to ACTH that bind the same epitope as Ab7A.H which contain a constant light chain sequence comprising the sequence set forth below:

(SEQ ID NO: 390)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or which contain the variable heavy chain sequence of SEQ ID NO: 362, and/or which further contain one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or which contain the variable light chain sequence of SEQ ID NO: 382, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362, and/or one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 361 or SEQ ID NO: 362 or polypeptides that are at least 90% or 95% identical thereto. In another embodiment of the invention, the antibody or antibody fragments of the invention comprise, or alternatively consist of, the polypeptide sequence of SEQ ID NO: 381 or SEQ ID NO: 382 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or the variable heavy chain sequence of SEQ ID NO: 362 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or the variable light chain sequence of SEQ ID NO: 382 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 362; the variable light chain region of SEQ ID NO: 382; the complementarity-determining regions (SEQ ID NO: 364; SEQ ID NO: 366; and SEQ ID NO: 368) of the variable heavy chain region of SEQ ID NO: 362; and the complementarity-determining regions (SEQ ID NO: 384; SEQ ID NO: 386; and SEQ ID NO: 388) of the variable light chain region of SEQ ID NO: 382 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 362; the variable light chain region of SEQ ID NO: 382; the framework regions (SEQ ID NO: 363; SEQ ID NO: 365; SEQ ID NO: 367; and SEQ ID NO: 369) of the variable heavy chain region of SEQ ID NO: 362; and the framework regions (SEQ ID NO: 383; SEQ ID NO: 385; SEQ ID NO: 387; and SEQ ID NO: 389) of the variable light chain region of SEQ ID NO: 382.

In a particularly preferred embodiment of the invention, the anti-ACTH antibody is Ab7A.H, comprising, or alternatively consisting of, SEQ ID NO: 361 and SEQ ID NO: 381 or SEQ ID NO: 362 and SEQ ID NO: 382, or an antibody or antibody fragment comprising the CDRs of Ab7A.H and having at least one of the biological activities set forth herein or is an anti-ACTH antibody that competes with Ab7A.H in binding ACTH, preferably one containing sequences that are at least 90%, 95%, 96%, 97%, 98% or 99% identical to that of Ab7A.H or an antibody that binds to the same or overlapping epitope(s) on ACTH as Ab7A.H.

In a further particularly preferred embodiment of the invention, antibody fragments comprise, or alternatively consist of, Fab (fragment antigen binding) fragments having binding specificity for ACTH. With respect to antibody Ab7A.H, the Fab fragment preferably includes the variable heavy chain sequence of SEQ ID NO: 362 and the variable light chain sequence of SEQ ID NO: 382 or sequences that are at least 90%, 95%, 96%, 97%, 98% or 99% identical thereto. This embodiment of the invention further includes Fabs containing additions, deletions, and variants of SEQ ID NO: 362 and/or SEQ ID NO: 382 which retain the binding specificity for ACTH.

In one embodiment of the invention described herein (infra), Fab fragments may be produced by enzymatic digestion (e.g., papain) of Ab7A.H. In another embodiment of the invention, anti-ACTH antibodies such as Ab7A.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab7A.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab10.H

In one embodiment, the invention includes antibodies and antibody fragments having binding specificity to ACTH that possess a heavy chain sequence comprising the sequence set forth below:

(SEQ ID NO: 401)
EVQLVESGGGLVQPGGSLRLSCAASGFTVSSADMIWVRQAPGKGLESIGM

IYDDGDTYYATSAKGRFTISRDNSKNTLYLQMNSLRAEDTAVYYCVKGVS

SVWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 402)
EVQLVESGGGLVQPGGSLRLSCAASGFTVSSADMIWVRQAPGKGLESIGM

IYDDGDTYYATSAKGRFTISRDNSKNTLYLQMNSLRAEDTAVYYCVKGVS

SVWGQGTLVTVSS.

In another embodiment, the invention includes antibodies and antibody fragments having binding specificity to ACTH that possess the same epitopic specificity as Ab10.H and which contain a constant heavy chain sequence comprising the sequence set forth below:

(SEQ ID NO: 410)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 421)
DIQMTQSPSTLSASVGDRVTITCQASENIYRSLAWYQQKPGKAPKLLIYS

ASTLASGVPSRFSGSGSGTEFTLTISSLQPDDFATYYCQSYDGSSSSSYG

VGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below (SEQ ID NO: 422)
DIQMTQSPSTLSASVGDRVTITCQASENIYRSLAWYQQKPGKAPKLLIYS

ASTLASGVPSRFSGSGSGTEFTLTISSLQPDDFATYYCQSYDGSSSSSYG

VGFGGGTKVEIKR.

In another embodiment, the invention includes antibodies and antibody fragments having binding specificity to ACTH that bind the same epitope as Ab10.H which contain a constant light chain (SEQ ID NO: 430)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or which contain the variable heavy chain sequence of SEQ ID NO: 402, and/or which further contain one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or which contain the variable light chain sequence of SEQ ID NO: 422, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402, and/or one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 401 or SEQ ID NO: 402 or polypeptides that are at least 90% or 95% identical thereto. In another embodiment of the invention, the antibody or antibody fragments of the invention comprise, or alternatively consist of, the polypeptide sequence of SEQ ID NO: 421 or SEQ ID NO: 422 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or the variable heavy chain sequence of SEQ ID NO: 402 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or the variable light chain sequence of SEQ ID NO: 422 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 402; the variable light chain region of SEQ ID NO: 422; the complementarity-determining regions (SEQ ID NO: 404; SEQ ID NO: 406; and SEQ ID NO: 408) of the variable heavy chain region of SEQ ID NO: 402; and the complementarity-determining regions (SEQ ID NO: 424; SEQ ID NO: 426; and SEQ ID NO: 428) of the variable light chain region of SEQ ID NO: 422 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 402; the variable light chain region of SEQ ID NO: 422; the framework regions (SEQ ID NO: 403; SEQ ID NO: 405; SEQ ID NO: 407; and SEQ ID NO: 409) of the variable heavy chain region of SEQ ID NO: 402; and the framework regions (SEQ ID NO: 423; SEQ ID NO: 425; SEQ ID NO: 427; and SEQ ID NO: 429) of the variable light chain region of SEQ ID NO: 422.

In a particularly preferred embodiment of the invention, the anti-ACTH antibody is Ab10.H, comprising, or alternatively consisting of, SEQ ID NO: 401 and SEQ ID NO: 421 or SEQ ID NO: 402 and SEQ ID NO: 422, or an antibody or antibody fragment comprising the CDRs of Ab10.H and having at least one of the biological activities set forth herein or is an anti-ACTH antibody that competes with Ab10.H in binding ACTH, preferably one containing sequences that are at least 90%, 95%, 96%, 97%, 98% or 99% identical to that of Ab10.H or an antibody that binds to the same or overlapping epitope(s) on ACTH as Ab10.H.

In a further particularly preferred embodiment of the invention, antibody fragments comprise, or alternatively consist of, Fab (fragment antigen binding) fragments having binding specificity for ACTH. With respect to antibody Ab10.H, the Fab fragment preferably includes the variable heavy chain sequence of SEQ ID NO: 402 and the variable light chain sequence of SEQ ID NO: 422 or sequences that are at least 90%, 95%, 96%, 97%, 98% or 99% identical thereto. This embodiment of the invention further includes Fabs containing additions, deletions, and variants of SEQ ID NO: 402 and/or SEQ ID NO: 422 which retain the binding specificity for ACTH.

In one embodiment of the invention described herein (infra), Fab fragments may be produced by enzymatic digestion (e.g., papain) of Ab10.H. In another embodiment of the invention, anti-ACTH antibodies such as Ab10.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab10.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab11.H

In one embodiment, the invention includes antibodies and antibody fragments having binding specificity to ACTH that possess a heavy chain sequence comprising the sequence set forth below:

(SEQ ID NO: 441)
EVQLVESGGGLVQPGGSLRLSCAASGFTVSAYDILWVRQAPGKGLESIGM

MYDDGDTYYATSAKGRFTISRDNSKNTLYLQMNSLRAEDTAVYYCVKGVS

NIWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 442)
EVQLVESGGGLVQPGGSLRLSCAASGFTVSAYDILWVRQAPGKGLESIGM

MYDDGDTYYATSAKGRFTISRDNSKNTLYLQMNSLRAEDTAVYYCVKGVS

NIWGQGTLVTVSS.

In another embodiment, the invention includes antibodies and antibody fragments having binding specificity to ACTH that possess the same epitopic specificity as Ab11.H and which contain a constant heavy chain sequence comprising the sequence set forth below:

(SEQ ID NO: 450)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having (SEQ ID NO: 461)
DIQMTQSPSTLSASVGDRVTITCQASQSIDSSLAWYQQKPGKAPKLLIYS

ASTLASGVPSRFSGSGSGTEFTLTISSLQPDDFATYYCQSYDGSSSSYYG

IGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 462)
DIQMTQSPSTLSASVGDRVTITCQASQSIDSSLAWYQQKPGKAPKLLIYS

ASTLASGVPSRFSGSGSGTEFTLTISSLQPDDFATYYCQSYDGSSSSYYG

IGFGGGTKVEIKR.

In another embodiment, the invention includes antibodies and antibody fragments having binding specificity to ACTH that bind the same epitope as Ab11.H which contain a constant light chain (SEQ ID NO: 470)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or which contain the variable heavy chain sequence of SEQ ID NO: 442, and/or which further contain one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or which contain the variable light chain sequence of SEQ ID NO: 462, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442, and/or one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 441 or SEQ ID NO: 442 or polypeptides that are at least 90% or 95% identical thereto. In another embodiment of the invention, the antibody or antibody fragments of the invention comprise, or alternatively consist of, the polypeptide sequence of SEQ ID NO: 461 or SEQ ID NO: 462 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or the variable heavy chain sequence of SEQ ID NO: 442 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or the variable light chain sequence of SEQ ID NO: 462 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 442; the variable light chain region of SEQ ID NO: 462; the complementarity-determining regions (SEQ ID NO: 444; SEQ ID NO: 446; and SEQ ID NO: 448) of the variable heavy chain region of SEQ ID NO: 442; and the complementarity-determining regions (SEQ ID NO: 464; SEQ ID NO: 466; and SEQ ID NO: 468) of the variable light chain region of SEQ ID NO: 462 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 442; the variable light chain region of SEQ ID NO: 462; the framework regions (SEQ ID NO: 443; SEQ ID NO: 445; SEQ ID NO: 447; and SEQ ID NO: 449) of the variable heavy chain region of SEQ ID NO: 442; and the framework regions (SEQ ID NO: 463; SEQ ID NO: 465; SEQ ID NO: 467; and SEQ ID NO: 469) of the variable light chain region of SEQ ID NO: 462.

In a particularly preferred embodiment of the invention, the anti-ACTH antibody is Ab11.H, comprising, or alternatively consisting of, SEQ ID NO: 441 and SEQ ID NO: 461 or SEQ ID NO: 442 and SEQ ID NO: 462, or an antibody or antibody fragment comprising the CDRs of Ab11.H and having at least one of the biological activities set forth herein or is an anti-ACTH antibody that competes with Ab1.H in binding ACTH, preferably one containing sequences that are at least 90%, 95%, 96%, 97%, 98% or 99% identical to that of Ab11.H or an antibody that binds to the same or overlapping epitope(s) on ACTH as Ab11.H.

In a further particularly preferred embodiment of the invention, antibody fragments comprise, or alternatively consist of, Fab (fragment antigen binding) fragments having binding specificity for ACTH. With respect to antibody Ab11.H, the Fab fragment preferably includes the variable heavy chain sequence of SEQ ID NO: 442 and the variable light chain sequence of SEQ ID NO: 462 or sequences that are at least 90%, 95%, 96%, 97%, 98% or 99% identical thereto. This embodiment of the invention further includes Fabs containing additions, deletions, and variants of SEQ ID NO: 442 and/or SEQ ID NO: 462 which retain the binding specificity for ACTH.

In one embodiment of the invention described herein (infra), Fab fragments may be produced by enzymatic digestion (e.g., papain) of Ab11.H. In another embodiment of the invention, anti-ACTH antibodies such as Ab11.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab11.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab11A.H

In one embodiment, the invention includes antibodies and antibody fragments having binding specificity to ACTH that possess a heavy chain sequence comprising the sequence set forth below:

```
                                        (SEQ ID NO: 481)
EVQLVESGGGLVQPGGSLRLSCAASGFTVSAYDILWVRQAPGKGLESIGM

MYDDGDTYYATSAKGRFTISRDNSKNTLYLQMNSLRAEDTAVYYCVKGVS

NIWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDKKVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.
```

In one embodiment, the invention includes antibodies and antibody fragments having binding specificity to ACTH that contain a variable heavy chain sequence comprising the sequence set forth below:

```
                                        (SEQ ID NO: 482)
EVQLVESGGGLVQPGGSLRLSCAASGFTVSAYDILWVRQAPGKGLESIGM

MYDDGDTYYATSAKGRFTISRDNSKNTLYLQMNSLRAEDTAVYYCVKGVS

NIWGQGTLVTVSS.
```

In another embodiment, the invention includes antibodies and antibody fragments having binding specificity to ACTH that possess the same epitopic specificity as Ab11A.H and which contain a constant heavy chain sequence comprising the sequence set forth below:

```
                                        (SEQ ID NO: 490)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to ACTH that contain a light chain sequence comprising the sequence set forth below:

```
                                        (SEQ ID NO: 501)
DIQMTQSPSTLSASVGDRVTITCQASQSIGSSLAWYQQKPGKAPKLLIYS

ASTLASGVPSRFSGSGSGTEFTLTISSLQPDDFATYYCQSYEGSSSSYYG

IGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.
```

In another embodiment, the invention includes antibodies and antibody fragments having binding specificity to ACTH that contain a variable light chain sequence comprising the sequence set forth below:

```
                                        (SEQ ID NO: 502)
DIQMTQSPSTLSASVGDRVTITCQASQSIGSSLAWYQQKPGKAPKLLIYS

ASTLASGVPSRFSGSGSGTEFTLTISSLQPDDFATYYCQSYEGSSSSYYG

IGFGGGTKVEIKR.
```

In another embodiment, the invention includes antibodies and antibody fragments having binding specificity to ACTH that bind the same epitope as Ab11A.H which contain a constant light chaian sequence comprising the sequence set forth below:

(SEQ ID NO: 510)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or which contain the variable heavy chain sequence of SEQ ID NO: 482, and/or which further contain one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or which contain the variable light chain sequence of SEQ ID NO: 502, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482, and/or one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 481 or SEQ ID NO: 482 or polypeptides that are at least 90% or 95% identical thereto. In another embodiment of the invention, the antibody or antibody fragments of the invention comprise, or alternatively consist of, the polypeptide sequence of SEQ ID NO: 501 or SEQ ID NO: 502 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or the variable heavy chain sequence of SEQ ID NO: 482 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or the variable light chain sequence of SEQ ID NO: 502 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 482; the variable light chain region of SEQ ID NO: 502; the complementarity-determining regions (SEQ ID NO: 484; SEQ ID NO: 486; and SEQ ID NO: 488) of the variable heavy chain region of SEQ ID NO: 482; and the complementarity-determining regions (SEQ ID NO: 504; SEQ ID NO: 506; and SEQ ID NO: 508) of the variable light chain region of SEQ ID NO: 502 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 482; the variable light chain region of SEQ ID NO: 502; the framework regions (SEQ ID NO: 483; SEQ ID NO: 485; SEQ ID NO: 487; and SEQ ID NO: 489) of the variable heavy chain region of SEQ ID NO: 482; and the framework regions (SEQ ID NO: 503; SEQ ID NO: 505; SEQ ID NO: 507; and SEQ ID NO: 509) of the variable light chain region of SEQ ID NO: 502.

In a particularly preferred embodiment of the invention, the anti-ACTH antibody is Ab11A.H, comprising, or alternatively consisting of, SEQ ID NO: 481 and SEQ ID NO: 501 or SEQ ID NO: 482 and SEQ ID NO: 502, or an antibody or antibody fragment comprising the CDRs of Ab11A.H and having at least one of the biological activities set forth herein or is an anti-ACTH antibody that competes with Ab11A.H in binding ACTH, preferably one containing sequences that are at least 90%, 95%, 96%, 97%, 98% or 99% identical to that of Ab11A.H or an antibody that binds to the same or overlapping epitope(s) on ACTH as Ab11A.H.

In a further particularly preferred embodiment of the invention, antibody fragments comprise, or alternatively consist of, Fab (fragment antigen binding) fragments having binding specificity for ACTH. With respect to antibody Ab1A.H, the Fab fragment preferably includes the variable heavy chain sequence of SEQ ID NO: 482 and the variable light chain sequence of SEQ ID NO: 502 or sequences that are at least 90%, 95%, 96%, 97%, 98% or 99% identical thereto. This embodiment of the invention further includes Fabs containing additions, deletions, and variants of SEQ ID NO: 482 and/or SEQ ID NO: 502 which retain the binding specificity for ACTH.

In one embodiment of the invention described herein (infra), Fab fragments may be produced by enzymatic digestion (e.g., papain) of Ab11A.H. In another embodiment of the invention, anti-ACTH antibodies such as Ab1A.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab1A.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab12.H

In one embodiment, the invention includes antibodies and antibody fragments having binding specificity to ACTH that possess a heavy chain sequence comprising the sequence set forth below:

(SEQ ID NO: 521)
EVQLVESGGGLVQPGGSLRLSCAASGSSLSDYDMIWVRQAPGKGLESIGI

IYDDGDTYYATSAKGRFTISRDNSKNTLYLQMNSLRAEDTAVYYCVKGVS

NMWGQGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDARVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 522)
EVQLVESGGGLVQPGGSLRLSCAASGSSLSDYDMIWVRQAPGKGLESIGI

IYDDGDTYYATSAKGRFTISRDNSKNTLYLQMNSLRAEDTAVYYCVKGVS

NMWGQGTLVTVSS.

In another embodiment, the invention includes antibodies and antibody fragments having binding specificity to ACTH that possess the same epitopic specificity as Ab12.H and which contain a constant heavy chain sequence comprising the sequence set forth below:

(SEQ ID NO: 530)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 541)
DIQMTQSPSTLSASVGDRVTITCQASQSIGSSLAWYQQKPGKAPKLLIYA

ASTLASGVPSRFSGSGSGTEFTLTISSLQPDDFATYYCQSYDGSSSSSYG

VGFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to ACTH that contain a variable light chain sequence comprising the sequence set forth below:

(SEQ ID NO: 542)
DIQMTQSPSTLSASVGDRVTITCQASQSIGSSLAWYQQKPGKAPKLLIYA

ASTLASGVPSRFSGSGSGTEFTLTISSLQPDDFATYYCQSYDGSSSSSYG

VGFGGGTKVEIKR.

In another embodiment, the invention includes antibodies and antibody fragments having binding specificity to ACTH that bind the same epitope as Ab12.H which contain a constant light chain sequence comprising the sequence set forth below:

(SEQ ID NO: 550)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 524; SEQ ID NO: 526; and SEQ ID NO: 528 which correspond to the complementarity-determining regions (CDRs, or hypervariable regions) of the heavy chain sequence of SEQ ID NO: 521 or which contain the variable heavy chain sequence of SEQ ID NO: 522, and/or which further contain one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or which contain the variable light chain sequence of SEQ ID NO: 542, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522, and/or one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 521 or SEQ ID NO: 522 or polypeptides that are at least 90% or 95% identical thereto. In another embodiment of the invention, the antibody or antibody fragments of the invention comprise, or alternatively consist of, the polypeptide sequence of SEQ ID NO: 541 or SEQ ID NO: 542 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 524; SEQ ID NO: 526; and SEQ ID NO: 528 which correspond to the complementarity-determining regions (CDRs, or hypervariable regions) of the heavy chain sequence of SEQ ID NO: 521 or the variable heavy chain sequence of SEQ ID NO: 522 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or the variable light chain sequence of SEQ ID NO: 542 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 522; the variable light chain region of SEQ ID NO: 542; the complementarity-determining regions (SEQ ID NO: 524; SEQ ID NO: 526; and SEQ ID NO: 528) of the variable heavy chain region of SEQ ID NO: 522; and the complementarity-determining regions (SEQ ID NO: 544; SEQ ID NO: 546; and SEQ ID NO: 548) of the variable light chain region of SEQ ID NO: 542 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 522; the variable light chain region of SEQ ID NO: 542; the framework regions (SEQ ID NO: 523; SEQ ID NO: 525; SEQ ID NO: 527; and SEQ ID NO: 529) of the variable heavy chain region of SEQ ID NO: 522; and the framework regions (SEQ ID NO: 543; SEQ ID NO: 545; SEQ ID NO: 547; and SEQ ID NO: 549) of the variable light chain region of SEQ ID NO: 542.

In a particularly preferred embodiment of the invention, the anti-ACTH antibody is Ab12.H, comprising, or alternatively consisting of, SEQ ID NO: 521 and SEQ ID NO: 541 or SEQ ID NO: 522 and SEQ ID NO: 542, or an antibody or antibody fragment comprising the CDRs of Ab12.H and having at least one of the biological activities set forth herein or is an anti-ACTH antibody that competes with Ab12.H in binding ACTH, preferably one containing sequences that are at least 90%, 95%, 96%, 97%, 98% or 99% identical to that of Ab12.H or an antibody that binds to the same or overlapping epitope(s) on ACTH as Ab12.H.

In a further particularly preferred embodiment of the invention, antibody fragments comprise, or alternatively consist of, Fab (fragment antigen binding) fragments having binding specificity for ACTH. With respect to antibody Ab12.H, the Fab fragment preferably includes the variable heavy chain sequence of SEQ ID NO: 522 and the variable light chain sequence of SEQ ID NO: 542 or sequences that are at least 90%, 95%, 96%, 97%, 98% or 99% identical thereto. This embodiment of the invention further includes Fabs containing additions, deletions, and variants of SEQ ID NO: 522 and/or SEQ ID NO: 542 which retain the binding specificity for ACTH.

In one embodiment of the invention described herein (infra), Fab fragments may be produced by enzymatic digestion (e.g., papain) of Ab12.H. In another embodiment of the invention, anti-ACTH antibodies such as Ab12.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab12.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab13.H

In one embodiment, the invention includes antibodies and antibody fragments having binding specificity to ACTH that possess a heavy chain sequence comprising the sequence set forth below:

(SEQ ID NO: 561)
EVQLVESGGGLVQPGGSLRLSCAASGFTVSSGYDICWVRQAPGKGLEWIG

CIDTGSGNTYYASSAKGRFTMSRDNSKNTVYLQMNSLRAEDTAVYYCAKG

ISSIWGQGTLVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDKKVEPKSCDKTHTCPPCPAPELLGGPSVFLFPPKPKDTLM

ISRTPEVTCVVVDVSHEDPEVKFNWYVDGVEVHNAKTKPREEQYASTYRV

VSVLTVLHQDWLNGKEYKCKVSNKALPAPIEKTISKAKGQPREPQVYTLP

PSREEMTKNQVSLTCLVKGFYPSDIAVEWESNGQPENNYKTTPPVLDSDG

SFFLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 562)
EVQLVESGGGLVQPGGSLRLSCAASGFTVSSGYDICWVRQAPGKGLEWIG

CIDTGSGNTYYASSAKGRFTMSRDNSKNTVYLQMNSLRAEDTAVYYCAKG

ISSIWGQGTLVTVSS.

In another embodiment, the invention includes antibodies and antibody fragments having binding specificity to ACTH that possess the same epitopic specificity as Ab13.H and which contain a constant heavy chain sequence comprising the sequence set forth below:

(SEQ ID NO: 570)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 581)
DIQMTQSPSTLSASVGDRVTITCQASQTISSDLAWYQQKPGKAPKLLIYA

ASKLTSGVPSRFSGSGSGTEFTLTISSLQPDDFATYYCQTYYDIIDDGAT

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to ACTH that contain a variable light chain sequence comprising the sequence set forth below:

(SEQ ID NO: 582)
DIQMTQSPSTLSASVGDRVTITCQASQTISSDLAWYQQKPGKAPKLLIYA

ASKLTSGVPSRFSGSGSGTEFTLTISSLQPDDFATYYCQTYYDIIDDGAT

FGGGTKVEIKR.

In another embodiment, the invention includes antibodies and antibody fragments having binding specificity to ACTH that bind the same epitope as Ab13.H which contain a constant light chain sequence comprising the sequence set forth below:

(SEQ ID NO: 590)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or which contain the variable heavy chain sequence of SEQ ID NO: 562, and/or which further contain one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or which contain the variable light chain sequence of SEQ ID NO: 582, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562, and/or one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 561 or SEQ ID NO: 562 or polypeptides that are at least 90% or 95% identical thereto. In another embodiment of the invention, the antibody or antibody fragments of the invention comprise, or alternatively consist of, the polypeptide sequence of SEQ ID NO: 581 or SEQ ID NO: 582 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or the variable heavy chain sequence of SEQ ID NO: 562 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or the variable light chain sequence of SEQ ID NO: 582 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 562; the variable light chain region of SEQ ID NO: 582; the complementarity-determining regions (SEQ ID NO: 564; SEQ ID NO: 566; and SEQ ID NO: 568) of the variable heavy chain region of SEQ ID NO: 562; and the complementarity-determining regions (SEQ ID NO: 584; SEQ ID NO: 586; and SEQ ID NO: 588) of the variable light chain region of SEQ ID NO: 582 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 562; the variable light chain region of SEQ ID NO: 582; the framework regions (SEQ ID NO: 563; SEQ ID NO: 565; SEQ ID NO: 567; and SEQ ID NO: 569) of the variable heavy chain region of SEQ ID NO: 562; and the framework regions (SEQ ID NO: 583; SEQ ID NO: 585; SEQ ID NO: 587; and SEQ ID NO: 589) of the variable light chain region of SEQ ID NO: 582.

In a particularly preferred embodiment of the invention, the anti-ACTH antibody is Ab13.H, comprising, or alternatively consisting of, SEQ ID NO: 561 and SEQ ID NO: 581 or SEQ ID NO: 562 and SEQ ID NO: 582, or an antibody or antibody fragment comprising the CDRs of Ab13.H and having at least one of the biological activities set forth herein or is an anti-ACTH antibody that competes with Ab13.H in binding ACTH, preferably one containing sequences that are at least 90%, 95%, 96%, 97%, 98% or 99% identical to that of Ab13.H or an antibody that binds to the same or overlapping epitope(s) on ACTH as Ab13.H.

In a further particularly preferred embodiment of the invention, antibody fragments comprise, or alternatively consist of, Fab (fragment antigen binding) fragments having binding specificity for ACTH. With respect to antibody Ab13.H, the Fab fragment preferably includes the variable heavy chain sequence of SEQ ID NO: 562 and the variable light chain sequence of SEQ ID NO: 582 or sequences that are at least 90%, 95%, 96%, 97%, 98% or 99% identical thereto. This embodiment of the invention further includes Fabs containing additions, deletions, and variants of SEQ ID NO: 562 and/or SEQ ID NO: 582 which retain the binding specificity for ACTH.

In one embodiment of the invention described herein (infra), Fab fragments may be produced by enzymatic digestion (e.g., papain) of Ab13.H. In another embodiment of the invention, anti-ACTH antibodies such as Ab13.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab13.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab15.H

In one embodiment, the invention includes antibodies and antibody fragments having binding specificity to ACTH that possess a heavy chain sequence comprising the sequence set forth below:

```
                                          (SEQ ID NO: 601)
QQQLVESGGGLVQPGGSLRLSCAASGFTVSDTYDMCWVRQAPGKGLEWIG

CIDTGSGDTYYPTSAKGRFTISRDNSKNTLYLQMNSLRAEDTAVYYCAKG

VSSLWGQGTLVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDARVEPKSCDKTHTCPPCPAPELLGGPSVFLFPPKPKDTLM

ISRTPEVTCVVVDVSHEDPEVKFNWYVDGVEVHNAKTKPREEQYASTYRV

VSVLTVLHQDWLNGKEYKCKVSNKALPAPIEKTISKAKGQPREPQVYTLP

PSREEMTKNQVSLTCLVKGFYPSDIAVEWESNGQPENNYKTTPPVLDSDG

SFFLYSKLTVDKSRWQQGNVFSCSVMHEALHNHYTQKSLSLSPGK.
```

In one embodiment, the invention includes antibodies and antibody fragments having binding specificity to ACTH that contain a variable heavy chain sequence comprising the sequence set forth below:

```
                                          (SEQ ID NO: 602)
QQQLVESGGGLVQPGGSLRLSCAASGFTVSDTYDMCWVRQAPGKGLEWIG

CIDTGSGDTYYPTSAKGRFTISRDNSKNTLYLQMNSLRAEDTAVYYCAKG

VSSLWGQGTLVTVSS.
```

In another embodiment, the invention includes antibodies and antibody fragments having binding specificity to ACTH that possess the same epitopic specificity as Ab15.H and which contain a constant heavy chain sequence comprising the sequence set forth below:

```
                                          (SEQ ID NO: 610)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to ACTH that contain a light chain sequence comprising the sequence set forth below:

```
                                          (SEQ ID NO: 621)
DIQMTQSPSTLSASVGDRVTITCQASEDIESDLAWYQQKPGKAPKLLIYG

ASTLKSGVPSRFSGSGSGTEYTLTISSLQPDDFATYYCQTYYDMADDGAS

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to ACTH that contain a variable light chain sequence comprising the sequence set forth below:

```
                                          (SEQ ID NO: 622)
DIQMTQSPSTLSASVGDRVTITCQASEDIESDLAWYQQKPGKAPKLLIYG

ASTLKSGVPSRFSGSGSGTEYTLTISSLQPDDFATYYCQTYYDMADDGAS

FGGGTKVEIKR.
```

In another embodiment, the invention includes antibodies and antibody fragments having binding specificity to ACTH that bind the same epitope as Ab15.H which contain a constant light chain sequence comprising the sequence set forth below:

```
                                          (SEQ ID NO: 630)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to ACTH that contain one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or which contain the variable heavy chain sequence of SEQ ID NO: 602, and/or which further contain one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or which contain the variable light chain sequence of SEQ ID NO: 622, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602, and/or one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 601 or SEQ ID NO: 602 or polypeptides that are at least 90% or 95% identical thereto. In another embodiment of the invention, the antibody or antibody fragments of the invention comprise, or alternatively consist of, the polypeptide sequence of SEQ ID NO: 621 or SEQ ID NO: 622 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or the variable heavy chain sequence of SEQ ID NO: 602 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or the variable light chain sequence of SEQ ID NO: 622 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 602; the variable light chain region of SEQ ID NO: 622; the complementarity-determining regions (SEQ ID NO: 604; SEQ ID NO: 606; and SEQ ID NO: 608) of the variable heavy chain region of SEQ ID NO: 602; and the complementarity-determining regions (SEQ ID NO: 624; SEQ ID NO: 626; and SEQ ID NO: 628) of the variable light chain region of SEQ ID NO: 622 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 602; the variable light chain region of SEQ ID NO: 622; the framework regions (SEQ ID NO: 603; SEQ ID NO: 605; SEQ ID NO: 607; and SEQ ID NO: 609) of the variable heavy chain region of SEQ ID NO: 602; and the framework regions (SEQ ID NO: 623; SEQ ID NO: 625; SEQ ID NO: 627; and SEQ ID NO: 629) of the variable light chain region of SEQ ID NO: 622.

In a particularly preferred embodiment of the invention, the anti-ACTH antibody is Ab15.H, comprising, or alternatively consisting of, SEQ ID NO: 601 and SEQ ID NO: 621 or SEQ ID NO: 602 and SEQ ID NO: 622, or an antibody or antibody fragment comprising the CDRs of Ab15.H and having at least one of the biological activities set forth herein or is an anti-ACTH antibody that competes with Ab15.H in binding ACTH, preferably one containing sequences that are at least 90%, 95%, 96%, 97%, 98% or 99% identical to that of Ab15.H or an antibody that binds to the same or overlapping epitope(s) on ACTH as Ab15.H.

In a further particularly preferred embodiment of the invention, antibody fragments comprise, or alternatively consist of, Fab (fragment antigen binding) fragments having binding specificity for ACTH. With respect to antibody Ab15.H, the Fab fragment preferably includes the variable heavy chain sequence of SEQ ID NO: 602 and the variable light chain sequence of SEQ ID NO: 622 or sequences that are at least 90%, 95%, 96%, 97%, 98% or 99% identical thereto. This embodiment of the invention further includes Fabs containing additions, deletions, and variants of SEQ ID NO: 602 and/or SEQ ID NO: 622 which retain the binding specificity for ACTH.

In one embodiment of the invention described herein (infra), Fab fragments may be produced by enzymatic digestion (e.g., papain) of Ab15.H. In another embodiment of the invention, anti-ACTH antibodies such as Ab15.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab15.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab17.H

In one embodiment, the invention includes antibodies and antibody fragments having binding specificity to ACTH that possess a heavy chain sequence comprising the sequence set forth below:

(SEQ ID NO: 641)
QQQLVESGGGLVQPGGSLRLSCAASGFTVSSGYDICWVRQAPGKGLEWIG

CIDTGSGNTYYASSAKGRFTISRDNSKNTLYLQMNSLRAEDTAVYYCAKG

ISSLWGQGTLVTVSSASTKGPSVFPLAPSSKSTSGGTAALGCLVKDYFPE

PVTVSWNSGALTSGVHTFPAVLQSSGLYSLSSVVTVPSSSLGTQTYICNV

NHKPSNTKVDARVEPKSCDKTHTCPPCPAPELLGGPSVFLFPPKPKDTLM

ISRTPEVTCVVVDVSHEDPEVKFNWYVDGVEVHNAKTKPREEQYASTYRV

VSVLTVLHQDWLNGKEYKCKVSNKALPAPIEKTISKAKGQPREPQVYTLP

PSREEMTKNQVSLTCLVKGFYPSDIAVEWESNGQPENNYKTTPPVLDSDG

SFFLYSKLTVDKSRWQQGNVFSCSVMHEALHNHYTQKSLSLSPGK.

In one embodiment, the invention includes antibodies and antibody fragments having binding specificity to ACTH that contain a variable heavy chain sequence comprising the sequence set forth below:

(SEQ ID NO: 642)
QQQLVESGGGLVQPGGSLRLSCAASGFTVSSGYDICWVRQAPGKGLEWIG

CIDTGSGNTYYASSAKGRFTISRDNSKNTLYLQMNSLRAEDTAVYYCAKG

ISSLWGQGTLVTVSS.

In another embodiment, the invention includes antibodies and antibody fragments having binding specificity to ACTH that possess the same epitopic specificity as Ab17.H and which contain a constant heavy chain sequence comprising the sequence set forth below:

(SEQ ID NO: 650)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDARVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to ACTH that contain a light chain sequence comprising the sequence set forth below:

(SEQ ID NO: 661)
DIQMTQSPSTLSASVGDRVTITCQASQTISSDLAWYQQKPGKAPKLLIYA

ASKLTSGVPSRFSGSGSGTEFTLTISSLQPDDFATYYCQTYYDISDDGAT

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to ACTH that contain a variable light chain sequence comprising the sequence set forth below:

(SEQ ID NO: 662)
DIQMTQSPSTLSASVGDRVTITCQASQTISSDLAWYQQKPGKAPKLLIYA

ASKLTSGVPSRFSGSGSGTEFTLTISSLQPDDFATYYCQTYYDISDDGAT

FGGGTKVEIKR.

In another embodiment, the invention includes antibodies and antibody fragments having binding specificity to ACTH that bind the same epitope as Ab17.H which contain a constant light chain sequence comprising the sequence set forth below:

(SEQ ID NO: 670)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to ACTH that contain one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or which contain the variable heavy chain sequence of SEQ ID NO: 642, and/or which further contain one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or which contain the variable light chain sequence of SEQ ID NO: 662, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-ACTH antibodies and antibody fragments comprising one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642, and/or one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662, or combinations of these polypeptide sequences or sequences which are at least 80%, 90%, 95%, 96%, 97%, 98% or 99% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-ACTH antibody or antibody fragments of the invention comprise, or alternatively consist of, the polypeptide sequence of SEQ ID NO: 641 or SEQ ID NO: 642 or polypeptides that are at least 90% or 95% identical thereto. In another embodiment of the invention, the antibody or antibody fragments of the invention comprise, or alternatively consist of, the polypeptide sequence of SEQ ID NO: 661 or SEQ ID NO: 662 or polypeptides that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or the variable heavy chain sequence of SEQ ID NO: 642 or sequences that are at least 90% or 95% identical thereto.

In a further embodiment of the invention, the antibody or antibody fragment having binding specificity to ACTH comprises, or alternatively consists of, one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or the variable light chain sequence of SEQ ID NO: 662 or sequences that are at least 90% or 95% identical thereto.

In a further embodiment of the invention, the antibody or antibody fragment having binding specificity to ACTH comprises, or alternatively consists of, one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642 or sequences that are at least 90% or 95% identical thereto.

In a further embodiment of the invention, the subject antibody or antibody fragment having binding specificity to ACTH comprises, or alternatively consists of, one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662 or sequences that are at least 90% or 95% identical thereto.

The invention also contemplates antibody or antibody fragments that include one or more of the antibody fragments described herein. In one embodiment of the invention, antibody or antibody fragments having binding specificity to ACTH comprise, or alternatively consist of, one, two, three or more, including all of the following antibody fragments: the variable heavy chain region of SEQ ID NO: 642; the variable light chain region of SEQ ID NO: 662; the complementarity-determining regions (SEQ ID NO: 644; SEQ ID NO: 646; and SEQ ID NO: 648) of the variable heavy chain region of SEQ ID NO: 642; and the complementarity-determining regions (SEQ ID NO: 664; SEQ ID NO: 666; and SEQ ID NO: 668) of the variable light chain region of SEQ ID NO: 662 or sequences that are at least 90% or 95% identical thereto.

The invention also contemplates antibody or antibody fragments that include one or more of the antibody fragments described herein. In one embodiment of the invention, fragments of the antibodies having binding specificity to ACTH comprise, or alternatively consist of, one, two, three or more, including all of the following antibody fragments: the variable heavy chain region of SEQ ID NO: 642; the variable light chain region of SEQ ID NO: 662; the framework regions (SEQ ID NO: 643; SEQ ID NO: 645; SEQ ID NO: 647; and SEQ ID NO: 649) of the variable heavy chain region of SEQ ID NO: 642; and the framework regions (SEQ ID NO: 663; SEQ ID NO: 665; SEQ ID NO: 667; and SEQ ID NO: 669) of the variable light chain region of SEQ ID NO: 662.

In a particularly preferred embodiment of the invention, the anti-ACTH antibody is Ab17.H, comprising, or alternatively consisting of, SEQ ID NO: 641 and SEQ ID NO: 661 or SEQ ID NO: 642 and SEQ ID NO: 662, or an antibody or antibody fragment comprising the CDRs of Ab17.H and having at least one of the biological activities set forth herein or is an anti-ACTH antibody that competes with Ab17.H in binding ACTH, preferably one containing sequences that are at least 90%, 95%, 96%, 97%, 98% or 99% identical to that of Ab17.H or an antibody that binds to the same or overlapping epitope(s) on ACTH as Ab17.H.

In a further particularly preferred embodiment of the invention, antibody fragments comprise, or alternatively consist of, Fab (fragment antigen binding) fragments having binding specificity for ACTH. With respect to antibody Ab17.H, the Fab fragment preferably includes the variable heavy chain sequence of SEQ ID NO: 642 and the variable light chain sequence of SEQ ID NO: 662 or sequences that are at least 90%, 95%, 96%, 97%, 98% or 99% identical thereto. This embodiment of the invention further includes Fabs containing additions, deletions, and variants of SEQ ID NO: 642 and/or SEQ ID NO: 662 which retain the binding specificity for ACTH.

In one embodiment of the invention described herein (infra), Fab fragments may be produced by enzymatic digestion (e.g., papain) of Ab17.H. In another embodiment of the invention, anti-ACTH antibodies such as Ab17.H or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to ACTH, including the heavy and/or light chains of Ab17.H as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

In another embodiment, the invention contemplates an isolated anti-ACTH antibody comprising a $V_H$ polypeptide sequence selected from: SEQ ID NO:2, SEQ ID NO:42, SEQ ID NO:82, SEQ ID NO:122, SEQ ID NO:162, SEQ ID NO:202, SEQ ID NO:242, SEQ ID NO:282, SEQ ID NO:322, SEQ ID NO:362, SEQ ID NO:402, SEQ ID NO:442, SEQ ID NO:482, SEQ ID NO:522, SEQ ID NO:562, SEQ ID NO:602, SEQ ID NO:642, or a variant thereof; and further comprising a $V_L$ polypeptide sequence selected from: SEQ ID NO:22, SEQ ID NO:62, SEQ ID NO: 102, SEQ ID NO: 142, SEQ ID NO:182, SEQ ID NO:222, SEQ ID NO:262, SEQ ID NO:302, SEQ ID NO:342, SEQ ID NO:382, SEQ ID NO:422, SEQ ID NO:462, SEQ ID NO:502, SEQ ID NO:542, SEQ ID NO:582, SEQ ID NO:622, SEQ ID NO:662, or a variant thereof, wherein one or more of the framework residues (FR residues) and/or CDR residues in said $V_H$ or $V_L$ polypeptide has been substituted with another amino acid residue resulting in an anti-ACTH antibody that specifically binds ACTH. The invention also includes humanized and chimeric forms of these antibodies. The chimeric and humanized antibodies may include an $F_c$ derived from IgG1, IgG2, IgG3, or IgG4 constant regions.

In one embodiment of the invention, the chimeric or humanized antibodies or fragments or $V_H$ or $V_L$ polypeptides originate or are derived from one or more rabbit antibodies, e.g., a rabbit antibody isolated from a clonal rabbit B cell population.

In some aspects, the invention provides a vector comprising a nucleic acid molecule encoding an anti-ACTH antibody or fragment thereof as disclosed herein. In some embodiments, the invention provides a host cell comprising a nucleic acid molecule encoding an anti-ACTH antibody or fragment thereof as disclosed herein.

In some aspects, the invention provides an isolated antibody or antibody fragment that competes for binding to ACTH with an antibody or antibody fragment disclosed herein.

In some aspects, the invention provides a nucleic acid molecule encoding an antibody or antibody fragment as disclosed herein.

In some aspects, the invention provides a pharmaceutical or diagnostic composition comprising at least one antibody or antibody fragment as disclosed herein.

In some aspects, the invention provides a method for treating or preventing a condition associated with elevated plasma cortisol, corticosterone, and/or aldosterone levels in a subject, comprising administering to a subject in need thereof an effective amount of at least one isolated antibody or antibody fragment as disclosed herein.

In some aspects, the invention provides a method of inhibiting binding of ACTH to MCR (e.g., MC2R) in a subject comprising administering an effective amount of at least one antibody or antibody fragment as disclosed herein.

In some aspects, the invention provides an antibody or antibody fragment that selectively binds to ACTH, wherein the antibody or antibody fragment binds to ACTH with a $K_D$ of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M; preferably, with a $K_D$ of less than or equal to $5 \times 10^{-10}$ M, $10^{-10}$ M, $5 \times 10^{-11}$ M, $10^{-11}$ M, $5 \times 10^{-12}$ M, or $10^{-12}$ M; more preferably, with a $K_D$ that is less than about 100 nM, less than about 50 pM, less than about 40 pM, less than about 25 pM, less than about 1 pM, between about 10 pM and about 100 pM, between about 1 pM and about 100 pM, or between about 1 pM and about 10 pM.

The inventive antibodies and fragments thereof may be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Antibodies or fragments thereof may also be chemically modified to provide additional advantages such as increased solubility, stability and circulating time (in vivo half-life) of the polypeptide, or decreased immunogenicity (See U.S. Pat. No. 4,179,337). The chemical moieties for derivatization may be selected from water soluble polymers such as polyethylene glycol, ethylene glycol/propylene glycol copolymers, carboxymethylcellulose, dextran, polyvinyl alcohol and the like. The antibodies and fragments thereof may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kDa and about 100 kDa (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, the polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kDa. Branched polyethylene glycols are described, for example, in U.S. Pat. No. 5,643,575; Morpurgo et al., *Appl. Biochem. Biotechnol.* 56:59-72 (1996); Vorobjev et al., Nucleosides Nucleotides 18:2745-2750 (1999); and Caliceti et al., *Bioconjug. Chem.* 10:638-646 (1999), the disclosures of each of which are incorporated herein by reference.

There are a number of attachment methods available to those skilled in the art, See e.g., EP 0 401 384, herein incorporated by reference (coupling PEG to G-CSF), See also Malik et al., *Exp. Hematol.* 20:1028-1035 (1992) (reporting pegylation of GM-CSF using tresyl chloride). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to polypeptides via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) or to more than one type of amino acid residue (e.g., lysine, histidine, aspartic acid, glutamic acid, cysteine and combinations thereof).

Alternatively, antibodies or fragments thereof may have increased in vivo half-lives via fusion with albumin (including but not limited to recombinant human serum albumin or fragments or variants thereof (See, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)) or other circulating blood proteins such as transferrin or ferritin. In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. Polynucleotides encoding fusion proteins of the invention are also encompassed by the invention.

Regarding detectable moieties, further exemplary enzymes include, but are not limited to, horseradish peroxidase, acetylcholinesterase, alkaline phosphatase, beta-galactosidase and luciferase. Further exemplary fluorescent materials include, but are not limited to, rhodamine, fluorescein, fluorescein isothiocyanate, umbelliferone, dichlorotriazinylamine, phycoerythrin, and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine 125 ($^{125}$I), Carbon 14 ($^{14}$C), Sulfur 35 ($^{35}$S), Tritium ($^{3}$H) and Phosphorus 32 ($^{32}$P).

Regarding functional moieties, exemplary cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, carminomycin, idarubicin, epirubicin, mitoxantrone and bisantrene; antibiotics include dactinomycin (actinomycin D), bleomycin, calicheamicin, mithramycin, and anthramycin (AMC); and antimitotic agents such as the vinca alkaloids, vincristine and vinblastine. Other cytotoxic agents include paclitaxel (Taxol), ricin, pseudomonas exotoxin, gemcitabine, cytochalasin B, gramicidin D, ethidium bromide, emetine, etoposide, teniposide, colchicine, dihydroxy anthracin dione, 1-dehydrotestosterone, glucocorticoids, procaine, tetracaine, lidocaine, propranolol, puromycin, procarbazine, hydroxyurea, asparaginase, corticosteroids, mitotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine and bleomycin. Toxic enzymes from plants and bacteria such as ricin, diphtheria toxin and Pseudomonas toxin may be conjugated to the humanized or chimeric antibodies, or binding fragments thereof (Youle, et al., *PNAS USA* 77:5483 (1980); Gilliland, et al., *PNAS USA* 77:4539 (1980); Krolick, et al., *PNAS USA* 77:5419 (1980)).

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the antibody, or binding fragments thereof, with or without the use of a complex-forming agent. Such radionuclides include beta-emitters such as Phosphorus-32 ($^{32}$P), Scandium-47 ($^{47}$Sc), Copper-67 ($^{67}$Cu), Gallium-67 ($^{67}$Ga), Yttrium-88 ($^{88}$Y), Yttrium-90 ($^{90}$Y), Iodine-125 ($^{125}$I), Iodine-131 ($^{131}$I), Samarium-153 ($^{153}$Sm), Lutetium-177 ($^{177}$Lu), Rhenium-186 ($^{186}$Re) or Rhenium-188 ($^{188}$Re), and alpha-emitters such as Astatine-211 ($^{211}$At), Lead-212 ($^{212}$Pb), Bismuth-212 ($^{212}$Bi) or -213 ($^{213}$Bi) or Actinium-225 ($^{225}$Ac).

Methods are known in the art for conjugating an antibody or binding fragment thereof to a detectable moiety and the like, such as for example those methods described by Hunter et al, *Nature* 144:945 (1962); David et al, *Biochemistry* 13:1014 (1974); Pain et al, *J. Immunol. Meth.* 40:219 (1981); and Nygren, J., *Histochem. and Cytochem.* 30:407 (1982).

Embodiments described herein further include variants and equivalents that are substantially homologous to the antibodies, antibody fragments, diabodies, SMIPs, camelbodies, nanobodies, IgNAR, polypeptides, variable regions and CDRs set forth herein. These may contain, e.g., conservative substitution mutations, (i.e., the substitution of one or more amino acids by similar amino acids). For example, conservative substitution refers to the substitution of an amino acid with another within the same general class, e.g., one acidic amino acid with another acidic amino acid, one basic amino acid with another basic amino acid, or one neutral amino acid by another neutral amino acid. What is intended by a conservative amino acid substitution is well known in the art.

In another embodiment, the invention contemplates polypeptide sequences having at least 90% or greater sequence homology to any one or more of the polypeptide sequences of antibody fragments, variable regions and CDRs set forth herein. More preferably, the invention contemplates polypeptide sequences having at least 95% or greater sequence homology, even more preferably at least 98% or greater sequence homology, and still more preferably at least 99% or greater sequence homology to any one or more of the polypeptide sequences of antibody fragments, variable regions and CDRs set forth herein. Methods for determining homology between nucleic acid and amino acid sequences are well known to those of ordinary skill in the art.

In another embodiment, the invention further contemplates the above-recited polypeptide homologs of the antibody fragments, variable regions and CDRs set forth herein further having anti-ACTH activity. Non-limiting examples of anti-ACTH activity are set forth herein.

In another embodiment, the invention further contemplates the generation and use of antibodies that bind any of the foregoing sequences, including, but not limited to, anti-idiotypic antibodies. In an exemplary embodiment, such an anti-idiotypic antibody could be administered to a subject who has received an anti-ACTH antibody to modulate, reduce, or neutralize, the effect of the anti-ACTH antibody. Such antibodies could also be useful for treatment of an autoimmune disease characterized by the presence of anti-ACTH antibodies. A further exemplary use of such antibodies, e.g., anti-idiotypic antibodies, is for detection of the anti-ACTH antibodies of the present invention, for example to monitor the levels of the anti-ACTH antibodies present in a subject's blood or other bodily fluids. For example, in one embodiment, the invention provides a method of using the anti-idiotypic antibody to monitor the in vivo levels of said anti-ACTH antibody or antibody fragment in a subject or to neutralize said anti-ACTH antibody in a subject being administered said anti-ACTH antibody or antibody fragment.

The present invention also contemplates anti-ACTH antibodies comprising any of the polypeptide or polynucleotide sequences described herein substituted for any of the other polynucleotide sequences described herein. For example, without limitation thereto, the present invention contemplates antibodies comprising the combination of any of the variable light chain and variable heavy chain sequences described herein, and further contemplates antibodies resulting from substitution of any of the CDR sequences described herein for any of the other CDR sequences described herein.

Exemplary Polynucleotides Encoding Anti-ACTH Antibody Polypeptides

The invention is further directed to polynucleotides encoding antibody polypeptides having binding specificity to ACTH.

Antibody Ab13

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 1:

(SEQ ID NO: 11)
cagcagctggaggagtccggggaggcctggtcaagcctggaggaaccct gacactcacctgcacagcctctggattctccttcagtagcggctacgaca tctgctgggcccgccagggtccagggaaggggctggagtggatcggatgc attgatactggtagtggtaacacttactacgcgagctgggcgaaaggccg attcaccatgtccagaacctcgtcgaccacggtgactctgcaagtgacca gtctgacagccgcggacacggccacctatttctgtgcgaagggtatttct agtatatggggcccgggcaccctggtcaccgtctcgagcgcctccaccaa gggcccatcggtcttccccctggcaccctcctccaagagcacctctgggg gcacagcggccctgggctgcctggtcaaggactactccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggac cgtcagtcttcctcttccccccaaaacccaaggacaccctcatgatctcc cggaccctgaggtcacatgcgtggtggtggacgtgagccacgaagaccc tgaggtcaagttcaactggtacgtggacggcgtggaggtgcataatgcca -continued
agacaaagccgcgggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcaggggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 2:

(SEQ ID NO: 12)
cagcagctggaggagtccggggaggcctggtcaagcctggaggaaccct gacactcacctgcacagcctctggattctccttcagtagcggctacgaca tctgctgggcccgccagggtccagggaaggggctggagtggatcggatgc attgatactggtagtggtaacacttactacgcgagctgggcgaaaggccg attcaccatgtccagaacctcgtcgaccacggtgactctgcaagtgacca gtctgacagccgcggacacggccacctatttctgtgcgaagggtatttct agtatatggggcccgggcaccctggtcaccgtctcgagc.

In another embodiment of the invention, polynucleotides of the invention comprise, or alternatively consist of, the following polynucleotide sequence encoding the constant heavy chain polypeptide sequence of SEQ ID NO: 10:

(SEQ ID NO: 20)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 21:

(SEQ ID NO: 31)
gatattgtgatgacccagactccagcctccgtgtctgaacctgtgggagg cacagtcaccatcaagtgccaggccagtcagaccattagtagcgacttag cctggtatcagcagaaaccagggcagcctcccaagctcctgatctatgct gcatccaagctgacatctggggtctcatcgcgcttcaaaggcggtggaac tgggacacagttcactctcaccatcagcgacctggagtgtgccgatgctg ccacttactactgtcaaacatattatgatattattgatgatggttgtact ttcggcggagggaccgaggtggtggtcaaacgtacggtagcggcccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtgt.

In another embodiment of the invention, polynucleotides of the invention comprise, or alternatively consist of, the following polynucleotide sequence encoding the variable light chain polypeptide sequence of SEQ ID NO: 22:

(SEQ ID NO: 32)
gatattgtgatgacccagactccagcctccgtgtctgaacctgtgggagg cacagtcaccatcaagtgccaggccagtcagaccattagtagcgacttag cctggtatcagcagaaaccagggcagcctcccaagctcctgatctatgct gcatccaagctgacatctggggtctcatcgcgcttcaaaggcggtggaac tgggacacagttcactctcaccatcagcgacctggagtgtgccgatgctg ccacttactactgtcaaacatattatgatattattgatgatggttgtact ttcggcggagggaccgaggtggtggtcaaacgt.

In another embodiment of the invention, polynucleotides of the invention comprise, or alternatively consist of, the following polynucleotide sequence encoding the constant light chain polypeptide sequence of SEQ ID NO: 30:

(SEQ ID NO: 40)
acggtagcggcccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 14; SEQ ID NO: 16; and SEQ ID NO: 18, which correspond to polynucleotides encoding the complementarity-determining regions (CDRs or hypervariable regions) of the heavy chain sequence of SEQ ID NO: 1 or the variable heavy chain sequence of SEQ ID NO: 2, and/or one or more of the polynucleotide sequences of SEQ ID NO: 34; SEQ ID NO: 36 and SEQ ID NO: 38, which correspond to the complementarity-determining regions (CDRs or hypervariable regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 13; SEQ ID NO: 15; SEQ ID NO: 17; and SEQ ID NO: 19, which correspond to polynucleotides encoding the framework regions (FRs or constant regions) of the heavy chain sequence of SEQ ID NO: 1 or the variable heavy chain sequence of SEQ ID NO: 2, and/or one or more of the polynucleotide sequences of SEQ ID NO: 33; SEQ ID NO: 35; SEQ ID NO: 37; and SEQ ID NO: 39, which correspond to the framework regions (FRs or constant regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 11 encoding the heavy chain sequence of SEQ ID NO: 1; the polynucleotide SEQ ID NO: 12 encoding the variable heavy chain sequence of SEQ ID NO: 2; the polynucleotide SEQ ID NO: 31 encoding the light chain sequence of SEQ ID NO: 21; the polynucleotide SEQ ID NO: 32 encoding the variable light chain sequence of SEQ ID NO: 22; polynucleotides encoding the complementarity-determining regions (SEQ ID NO: 14; SEQ ID NO: 16; and SEQ ID NO: 18) of the heavy chain sequence of SEQ ID NO: 1 or the variable heavy chain sequence of SEQ ID NO: 2; polynucleotides encoding the complementarity-determining regions (SEQ ID NO: 34; SEQ ID NO: 36; and SEQ ID NO: 38) of the light chain sequence of SEQ ID NO: 21 or the variable light chain sequence of SEQ ID NO: 22; polynucleotides encoding the framework regions (SEQ ID NO: 13; SEQ ID NO: 15; SEQ ID NO: 17; and SEQ ID NO: 19) of the heavy chain sequence of SEQ ID NO: 1 or the variable heavy chain sequence of SEQ ID NO: 2; and polynucleotides encoding the framework regions (SEQ ID NO: 33; SEQ ID NO: 35; SEQ ID NO: 37; and SEQ ID NO: 39) of the light chain sequence of SEQ ID NO: 21 or the variable light chain sequence of SEQ ID NO: 22.

In a preferred embodiment of the invention, polynucleotides of the invention comprise, or alternatively consist of, polynucleotides encoding Fab (fragment antigen binding) fragments having binding specificity for ACTH. With respect to antibody Ab13, the polynucleotides encoding the full length Ab13 antibody comprise, or alternatively consist of, the polynucleotide SEQ ID NO: 11 encoding the heavy chain sequence of SEQ ID NO: 1 and the polynucleotide SEQ ID NO: 31 encoding the light chain sequence of SEQ ID NO: 21.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab13 following expression of the full-length polynucleotides in a suitable host. In another embodiment of the invention, anti-ACTH antibodies such as Ab13 or Fab fragments thereof may be produced via expression of Ab13 polynucleotides in mammalian cells such as CHO, NSO or HEK 293 cells, fungal, insect, or microbial systems such as yeast cells (for example diploid yeast such as diploid *Pichia*) and other yeast strains.

Suitable *Pichia* species include, but are not limited to, *Pichia pastoris*.

Antibody Ab15

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 41:

(SEQ ID NO: 51)
cagcagcaactggaagagtccggggggaggcctagtcaagcctggaggaac cctgacactcacctgtaaaggctctggaattgccttcagtgacacctacg acatgtgctgggtccgccaggctccggggaaggggctggaatggatcgga tgcatcgatactggtagtggtgacacttactacccgacctgggcgaaagg ccgattcaccatctccaaaccctcgtcgaccacggtggatctgaaaatga ccagtctgacagccgcggacacggccacatatttctgtgcgaagggtgtt tccagtttatggggccaggggaccctcgtcaccgtctcgagcgcctccac caagggcccatcggtcttccccctggcaccctcctccaagagcacctctg ggggcacagcggccctgggctgcctggtcaaggactacttccccgaaccg gtgacggtgtcgtggaactcaggcgccctgaccagcggcgtgcacacctt cccggctgtcctacagtcctcaggactctactccctcagcagcgtggtga ccgtgcctccagcagcttgggcacccagacctacatctgcaacgtgaat cacaagcccagcaacaccaaggtggacgcgagagttgagcccaaatcttg tgacaaaactcacacatgcccaccgtgcccagcacctgaactcctggggg gaccgtcagtcttcctcttccccccaaaacccaaggacaccctcatgatc tcccggacccctgaggtcacatgcgtggtggtggacgtgagccacgaaga ccctgaggtcaagttcaactggtacgtggacggcgtggaggtgcataatg ccaagacaaagccgcgggaggagcagtacgccagcacgtaccgtgtggtc agcgtcctcaccgtcctgcaccaggactggctgaatggcaaggagtacaa gtgcaaggtctccaacaaagcccctcccagccccatcgagaaaaccatct ccaaagccaaagggcagccccgagaaccacaggtgtacaccctgccccca tcccgggaggagatgaccaagaaccaggtcagcctgacctgcctggtcaa aggcttctatcccagcgacatcgccgtggagtgggagagcaatgggcagc cggagaacaactacaagaccacgcctcccgtgctggactccgacggctcc ttcttcctctacagcaagctcaccgtggacaagagcaggtggcagcaggg gaacgtcttctcatgctccgtgatgcatgaggctctgcacaaccactaca cgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 42:

(SEQ ID NO: 52)
cagcagcaactggaagagtccggggggaggcctagtcaagcctggaggaac cctgacactcacctgtaaaggctctggaattgccttcagtgacacctacg acatgtgctgggtccgccaggctccggggaaggggctggaatggatcgga tgcatcgatactggtagtggtgacacttactacccgacctgggcgaaagg ccgattcaccatctccaaaccctcgtcgaccacggtggatctgaaaatga ccagtctgacagccgcggacacggccacatatttctgtgcgaagggtgtt tccagtttatggggccaggggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 50:

(SEQ ID NO: 60)
gcctccaccaagggcccatcggtcttccccctggcaccctcctccaagag cacctctggggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc -continued aaatcttgtgacaaaactcacacatgcccaccgtgcccagcacctgaact cctgggggaccgtcagtcttcctcttcccccaaaacccaaggacaccc tcatgatctcccggaccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 61:

(SEQ ID NO: 71)
gacatcgtgatgacccagactccagcctccgtgtctgaacctgtgggagg cacagtcaccatcaagtgccaggccagtgaggacattgaaagcgatttag cctggtatcagcagaaaccagggcagcctcccaagctcctgatctatggt gcatccactctgaagtctggggtctcatcaaggttcagaggcagtggatc tgggacagagtacactctcaccatcagcgacctggagtgtgccgatgctg ccacttactactgtcaaacctattatgatatggctgatgatggttgtagt ttcggcggagggaccgaggtggtggtcaaacgtacggtagcggcccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.

In another embodiment of the invention, polynucleotides of the invention comprise, or alternatively consist of, the following polynucleotide sequence encoding the variable light chain polypeptide sequence of SEQ ID NO: 62:

(SEQ ID NO: 72)
gacatcgtgatgacccagactccagcctccgtgtctgaacctgtgggagg cacagtcaccatcaagtgccaggccagtgaggacattgaaagcgatttag cctggtatcagcagaaaccagggcagcctcccaagctcctgatctatggt gcatccactctgaagtctggggtctcatcaaggttcagaggcagtggatc tgggacagagtacactctcaccatcagcgacctggagtgtgccgatgctg ccacttactactgtcaaacctattatgatatggctgatgatggttgtagt ttcggcggagggaccgaggtggtggtcaaacgt.

In another embodiment of the invention, polynucleotides of the invention comprise, or alternatively consist of, the following polynucleotide sequence encoding the constant light chain polypeptide sequence of SEQ ID NO: 70:

(SEQ ID NO: 80)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 54; SEQ ID NO: 56; and SEQ ID NO: 58, which correspond to polynucleotides encoding the complementarity-determining regions (CDRs or hypervariable regions) of the heavy chain sequence of SEQ ID NO: 41 or the variable heavy chain sequence of SEQ ID NO: 42, and/or one or more of the polynucleotide sequences of SEQ ID NO: 74; SEQ ID NO: 76 and SEQ ID NO: 78, which correspond to the complementarity-determining regions (CDRs or hypervariable regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 53; SEQ ID NO: 55; SEQ ID NO: 57; and SEQ ID NO: 59, which correspond to polynucleotides encoding the framework regions (FRs or constant regions) of the heavy chain sequence of SEQ ID NO: 41 or the variable heavy chain sequence of SEQ ID NO: 42, and/or one or more of the polynucleotide sequences of SEQ ID NO: 73; SEQ ID NO: 75; SEQ ID NO: 77; and SEQ ID NO: 79, which correspond to the framework regions (FRs or constant regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 51 encoding the heavy chain sequence of SEQ ID NO: 41; the polynucleotide SEQ ID NO: 52 encoding the variable heavy chain sequence of SEQ ID NO: 42; the polynucleotide SEQ ID NO: 71 encoding the light chain sequence of SEQ ID NO: 61; the polynucleotide SEQ ID NO: 72 encoding the variable light chain sequence of SEQ ID NO: 62; polynucleotides encoding the complementarity-determining regions (SEQ ID NO: 54; SEQ ID NO: 56; and SEQ ID NO: 58) of the heavy chain sequence of SEQ ID NO: 41 or the variable heavy chain sequence of SEQ ID NO: 42; polynucleotides encoding the complementarity-determining regions (SEQ ID NO: 74; SEQ ID NO: 76; and SEQ ID NO: 78) of the light chain sequence of SEQ ID NO: 61 or the variable light chain sequence of SEQ ID NO: 62; polynucleotides encoding the framework regions (SEQ ID NO: 53; SEQ ID NO: 55; SEQ ID NO: 57; and SEQ ID NO: 59) of the heavy chain sequence of SEQ ID NO: 41 or the variable heavy chain sequence of SEQ ID NO: 42; and polynucleotides encoding the framework regions (SEQ ID NO: 73; SEQ ID NO: 75; SEQ ID NO: 77; and SEQ ID NO: 79) of the light chain sequence of SEQ ID NO: 61 or the variable light chain sequence of SEQ ID NO: 62.

In a preferred embodiment of the invention, polynucleotides of the invention comprise, or alternatively consist of, polynucleotides encoding Fab (fragment antigen binding) fragments having binding specificity for ACTH. With respect to antibody Ab15, the polynucleotides encoding the full length Ab15 antibody comprise, or alternatively consist of, the polynucleotide SEQ ID NO: 51 encoding the heavy chain sequence of SEQ ID NO: 41 and the polynucleotide SEQ ID NO: 71 encoding the light chain sequence of SEQ ID NO: 61.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab15 following expression of the full-length polynucleotides in a suitable host. In another embodiment of the invention, anti-ACTH antibodies such as Ab15 or Fab fragments thereof may be produced via expression of Ab15 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab17

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 81:

(SEQ ID NO: 91)
cagcagcagctggaggagtccggggaggcctggtcaagcctggaggaac cctgacactcacctgcaaagcctctggattctccttcagtagcggctacg acatctgctgggcccgccagggtccagggaaggggctggagtggatcgga tgcattgatactggtagtggtaacacttactacgcgagctgggcgaaagg ccgattcaccatctccagaacctcgtcgaccacggtgactctgcaaatga ccagtctgacagccgcggacacggccacctatttctgtgcgaagggtatt tctagtttatggggcccgggcaccctggtcaccgtctcgagcgcctccac caagggcccatcggtcttcccctggcaccctcctccaagagcacctctg ggggcacagcggccctgggctgcctggtcaaggactacttccccgaaccg gtgacggtgtcgtggaactcaggcgccctgaccagcggcgtgcacaccctt cccggctgtcctacagtcctcaggactctactccctcagcagcgtggtga ccgtgccctccagcagcttgggcacccagacctacatctgcaacgtgaat cacaagcccagcaacaccaaggtggacgcgagagttgagcccaaatcttg tgacaaaactcacacatgcccaccgtgcccagcacctgaactcctgggg gaccgtcagtcttcctcttccccccaaaacccaaggacaccctcatgatc tcccggacccctgaggtcacatgcgtggtggtggacgtgagccacgaaga ccctgaggtcaagttcaactggtacgtggacggcgtggaggtgcataatg ccaagacaaagccgcgggaggagcagtacgccagcacgtaccgtgtggtc agcgtcctcaccgtcctgcaccaggactggctgaatggcaaggagtacaa gtgcaaggtctccaacaaagcctcccagccccatcgagaaaaccatct ccaaagccaaagggcagccccgagaaccacaggtgtacaccctgccccca tcccgggaggagatgaccaagaaccaggtcagcctgacctgcctggtcaa aggcttctatcccagcgacatcgccgtggagtgggagagcaatgggcagc cggagaacaactacaagaccacgcctcccgtgctggactccgacggctcc ttcttcctctacagcaagctcaccgtggacaagagcaggtggcagcaggg gaacgtcttctcatgctccgtgatgcatgaggctctgcacaaccactaca cgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 82:

(SEQ ID NO: 92)
cagcagcagctggaggagtccggggaggcctggtcaagcctggaggaac cctgacactcacctgcaaagcctctggattctccttcagtagcggctacg acatctgctgggcccgccagggtccagggaaggggctggagtggatcgga tgcattgatactggtagtggtaacacttactacgcgagctgggcgaaagg ccgattcaccatctccagaacctcgtcgaccacggtgactctgcaaatga ccagtctgacagccgcggacacggccacctatttctgtgcgaagggtatt tctagtttatggggcccgggcaccctggtcaccgtctcgagc.

In another embodiment of the invention, polynucleotides of the invention comprise, or alternatively consist of, the following polynucleotide sequence encoding the constant heavy chain polypeptide sequence of SEQ ID NO: 90.

(SEQ ID NO: 100)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 101:

(SEQ ID NO: 111)
gatattgtgatgacccagactccagcctccgtgtctgaacctgtgggagg cacagtcaccatcaagtgccaggccagtcagaccattagtagcgacttag cctggtatcagcagaaaccagggcagcctcccaagctcctgatctatgct gcatccaaactgacatctggggtctcatcgcggttcaaaggcggtggaac tgggacacagttcactctcaccatcagcgacctggagtgtgccgatgctg ccacttactactgtcaaacctattatgatattagtgatgatggttgtact ttcggcggagggaccgaggtggtggtcaaacgtacggtagcggcccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.

In another embodiment of the invention, polynucleotides of the invention comprise, or alternatively consist of, the following polynucleotide sequence encoding the variable light chain polypeptide sequence of SEQ ID NO: 102:

(SEQ ID NO: 112)
gatattgtgatgacccagactccagcctccgtgtctgaacctgtgggagg cacagtcaccatcaagtgccaggccagtcagaccattagtagcgacttag cctggtatcagcagaaaccagggcagcctcccaagctcctgatctatgct gcatccaaactgacatctggggtctcatcgcggttcaaaggcggtggaac tgggacacagttcactctcaccatcagcgacctggagtgtgccgatgctg ccacttactactgtcaaacctattatgatattagtgatgatggttgtact ttcggcggagggaccgaggtggtggtcaaacgt.

In another embodiment of the invention, polynucleotides of the invention comprise, or alternatively consist of, the following polynucleotide sequence encoding the constant light chain polypeptide sequence of SEQ ID NO: 110:

(SEQ ID NO: 120)
acggtagcggcccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 94; SEQ ID NO: 96; and SEQ ID NO: 98, which correspond to polynucleotides encoding the complementarity-determining regions (CDRs or hypervariable regions) of the heavy chain sequence of SEQ ID NO: 81 or the variable heavy chain sequence of SEQ ID NO: 82, and/or one or more of the polynucleotide sequences of SEQ ID NO: 114; SEQ ID NO: 116 and SEQ ID NO: 118, which correspond to the complementarity-determining regions (CDRs or hypervariable regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 93; SEQ ID NO: 95; SEQ ID NO: 97; and SEQ ID NO: 99, which correspond to polynucleotides encoding the framework regions (FRs or constant regions) of the heavy chain sequence of SEQ ID NO: 81 or the variable heavy chain sequence of SEQ ID NO: 82, and/or one or more of the polynucleotide sequences of SEQ ID NO: 113; SEQ ID NO: 115; SEQ ID NO: 117; and SEQ ID NO: 119, which correspond to the framework regions (FRs or constant regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 91 encoding the heavy chain sequence of SEQ ID NO: 81; the polynucleotide SEQ ID NO: 92 encoding the variable heavy chain sequence of SEQ ID NO: 82; the polynucleotide SEQ ID NO: 111 encoding the light chain sequence of SEQ ID NO: 101; the polynucleotide SEQ ID NO: 112 encoding the variable light chain sequence of SEQ ID NO: 102; polynucleotides encoding the complementarity-determining regions (SEQ ID NO: 94; SEQ ID NO: 96; and SEQ ID NO: 98) of the heavy chain sequence of SEQ ID NO: 81 or the variable heavy chain sequence of SEQ ID NO: 82; polynucleotides encoding the complementarity-determining regions (SEQ ID NO: 114; SEQ ID NO: 116; and SEQ ID NO: 118) of the light chain sequence of SEQ ID NO: 101 or the variable light chain sequence of SEQ ID NO: 102; polynucleotides encoding the framework regions (SEQ ID NO: 93; SEQ ID NO: 95; SEQ ID NO: 97; and SEQ ID NO: 99) of the heavy chain sequence of SEQ ID NO: 81 or the variable heavy chain sequence of SEQ ID NO: 82; and polynucleotides encoding the framework regions (SEQ ID NO: 113; SEQ ID NO: 115; SEQ ID NO: 117; and SEQ ID NO: 119) of the light chain sequence of SEQ ID NO: 101 or the variable light chain sequence of SEQ ID NO: 102.

In a preferred embodiment of the invention, polynucleotides of the invention comprise, or alternatively consist of, polynucleotides encoding Fab (fragment antigen binding) fragments having binding specificity for ACTH. With respect to antibody Ab17, the polynucleotides encoding the full length Ab17 antibody comprise, or alternatively consist of, the polynucleotide SEQ ID NO: 91 encoding the heavy chain sequence of SEQ ID NO: 81 and the polynucleotide SEQ ID NO: 111 encoding the light chain sequence of SEQ ID NO: 101.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab17 following expression of the full-length polynucleotides in a suitable host. In another embodiment of the invention, anti-ACTH antibodies such as Ab17 or Fab fragments thereof may be produced via expression of Ab17 polynucleotides in mammalian cells such as CHO, NSO or HEK 293 cells, fungal, insect, or microbial systems such as yeast cells (for example diploid yeast such as diploid *Pichia*) and other yeast strains.

Suitable *Pichia* species include, but are not limited to, *Pichia pastoris*.

Antibody Ab1.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 121:

(SEQ ID NO: 131)
gaggtgcagcttgtggagtctgggggaggcttggtccagcctggggggtc cctgagactctcctgtgcagcctctggattcaccgtcagtaactatgaca tgatctgggtccgtcaggctccagggaaggggctggagtccatcggaatg atttatgatgatggtgacacatactacgctagttctgctaaaggccgatt caccatctccagagacaattccaagaacaccctgtatcttcaaatgaaca gcctgagagctgaggacactgctgtgtattactgtgtcaaaggtgtgagt aatcactggggccaagggaccctcgtcaccgtctcgagcgcctccaccaa gggcccatcggtcttccccctggcacctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggac cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcaggggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 122:

(SEQ ID NO: 132)
gaggtgcagcttgtggagtctgggggaggcttggtccagcctggggggtc cctgagactctcctgtgcagcctctggattcaccgtcagtaactatgaca tgatctgggtccgtcaggctccagggaaggggctggagtccatcggaatg atttatgatgatggtgacacatactacgctagttctgctaaaggccgatt -continued
caccatctccagagacaattccaagaacaccctgtatcttcaaatgaaca gcctgagagctgaggacactgctgtgtattactgtgtcaaaggtgtgagt aatcactggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 130:

(SEQ ID NO: 140)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 141:

(SEQ ID NO: 151)
gacatccagatgacccagtctccttccaccctgtctgcatctgtaggaga cagagtcaccatcacttgtcaggccagtcagagcattagtagttacttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtggtagtagttatggt gttggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag -continued
tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 142:

(SEQ ID NO: 152)
gacatccagatgacccagtctccttccaccctgtctgcatctgtaggaga cagagtcaccatcacttgtcaggccagtcagagcattagtagttacttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtggtagtagttatggt gttggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 150:

(SEQ ID NO: 160)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 134; SEQ ID NO: 136; and SEQ ID NO: 138, which correspond to polynucleotides encoding the complementarity-determining regions (CDRs or hypervariable regions) of the heavy chain sequence of SEQ ID NO: 121 or the variable heavy chain sequence of SEQ ID NO: 122, and/or one or more of the polynucleotide sequences of SEQ ID NO: 154; SEQ ID NO: 156 and SEQ ID NO: 158, which correspond to the complementarity-determining regions (CDRs or hypervariable regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 133; SEQ ID NO: 135; SEQ ID NO: 137; and SEQ ID NO: 139, which correspond to polynucleotides encoding the framework regions (FRs or constant regions) of the heavy chain sequence of SEQ ID NO: 121 or the variable heavy chain sequence of SEQ ID NO: 122, and/or one or more of the polynucleotide sequences of SEQ ID NO: 153; SEQ ID NO: 155; SEQ ID NO: 157; and SEQ ID NO: 159, which correspond to the framework regions (FRs or constant regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 131 encoding the heavy chain sequence of SEQ ID NO: 121; the polynucleotide SEQ ID NO: 132 encoding the variable heavy chain sequence of SEQ ID NO: 122; the polynucleotide SEQ ID NO: 151 encoding the light chain sequence of SEQ ID NO: 141; the polynucleotide SEQ ID NO: 152 encoding the variable light chain sequence of SEQ ID NO: 142; polynucleotides encoding the complementarity-determining regions (SEQ ID NO: 134; SEQ ID NO: 136; and SEQ ID NO: 138) of the heavy chain sequence of SEQ ID NO: 121 or the variable heavy chain sequence of SEQ ID NO: 122; polynucleotides encoding the complementarity-determining regions (SEQ ID NO: 154; SEQ ID NO: 156; and SEQ ID NO: 158) of the light chain sequence of SEQ ID NO: 141 or the variable light chain sequence of SEQ ID NO: 142; polynucleotides encoding the framework regions (SEQ ID NO: 133; SEQ ID NO: 135; SEQ ID NO: 137; and SEQ ID NO: 139) of the heavy chain sequence of SEQ ID NO: 121 or the variable heavy chain sequence of SEQ ID NO: 122; and polynucleotides encoding the framework regions (SEQ ID NO: 153; SEQ ID NO: 155; SEQ ID NO: 157; and SEQ ID NO: 159) of the light chain sequence of SEQ ID NO: 141 or the variable light chain sequence of SEQ ID NO: 142.

In a preferred embodiment of the invention, polynucleotides of the invention comprise, or alternatively consist of, polynucleotides encoding Fab (fragment antigen binding) fragments having binding specificity for ACTH. With respect to antibody Ab1.H, the polynucleotides encoding the full length Ab1.H antibody comprise, or alternatively consist of, the polynucleotide SEQ ID NO: 131 encoding the heavy chain sequence of SEQ ID NO: 121 and the polynucleotide SEQ ID NO: 151 encoding the light chain sequence of SEQ ID NO: 141.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab1.H following expression of the full-length polynucleotides in a suitable host. In another embodiment of the invention, anti-ACTH antibodies such as Ab1.H or Fab fragments thereof may be produced via expression of Ab1.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab2.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 161:

(SEQ ID NO: 171)
gaggtgcagcttgtggagtctgggggaggcttggtccagcctgggggtc cctgagactctcctgtgcagcctctggattcaccgtcagtaagtatgaca tgatctgggtccgtcaggctccagggaaggggctggagtccatcggaatc atttatgatgatggcgacacatattacgctagttctgctaaaggccgatt caccatctccagagacaattccaagaacaccctgtatcttcaaatgaaca gcctgagagctgaggacactgctgtgtattactgtgtcaaaggtgtgagt aatatctgggccaagggaccctcgtcaccgtctcgagcgcctccaccaa gggcccatcggtcttccccctggcaccctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggggac cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcagggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 162:

(SEQ ID NO: 172)
gaggtgcagcttgtggagtctgggggaggcttggtccagcctggggggtc cctgagactctcctgtgcagcctctggattcaccgtcagtaagtatgaca tgatctgggtccgtcaggctccagggaaggggctggagtccatcggaatc atttatgatgatggcgacacatattacgctagttctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 170:

(SEQ ID NO: 180)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 181:

(SEQ ID NO: 191)
gacatccagatgacccagtctccttccaccctgtctgcatctgtaggaga cagagtcaccatcacttgtcaggccagtcagagcattagtaactacttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgagggtagtagtagtagtagttatggt gttggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacaggggg agagtgt.

In another embodiment of the invention, polynucleotides of the invention comprise, or alternatively consist of, the following polynucleotide sequence encoding the variable light chain polypeptide sequence of SEQ ID NO: 182:

(SEQ ID NO: 192)
gacatccagatgacccagtctccttccaccctgtctgcatctgtaggaga cagagtcaccatcacttgtcaggccagtcagagcattagtaactacttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgagggtagtagtagtagtagttatggt gttggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 190:

(SEQ ID NO: 200)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 174; SEQ ID NO: 176; and SEQ ID NO: 178, which correspond to polynucleotides encoding the complementarity-determining regions (CDRs or hypervariable regions) of the heavy chain sequence of SEQ ID NO: 161 or the variable heavy chain sequence of SEQ ID NO: 162, and/or one or more of the polynucleotide sequences of SEQ ID NO: 194; SEQ ID NO:

196 and SEQ ID NO: 198, which correspond to the complementarity-determining regions (CDRs or hypervariable regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 173; SEQ ID NO: 175; SEQ ID NO: 177; and SEQ ID NO: 179, which correspond to polynucleotides encoding the framework regions (FRs or constant regions) of the heavy chain sequence of SEQ ID NO: 161 or the variable heavy chain sequence of SEQ ID NO: 162, and/or one or more of the polynucleotide sequences of SEQ ID NO: 193; SEQ ID NO: 195; SEQ ID NO: 197; and SEQ ID NO: 199, which correspond to the framework regions (FRs or constant regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 171 encoding the heavy chain sequence of SEQ ID NO: 161; the polynucleotide SEQ ID NO: 172 encoding the variable heavy chain sequence of SEQ ID NO: 162; the polynucleotide SEQ ID NO: 191 encoding the light chain sequence of SEQ ID NO: 181; the polynucleotide SEQ ID NO: 192 encoding the variable light chain sequence of SEQ ID NO: 182; polynucleotides encoding the complementarity-determining regions (SEQ ID NO: 174; SEQ ID NO: 176; and SEQ ID NO: 178) of the heavy chain sequence of SEQ ID NO: 161 or the variable heavy chain sequence of SEQ ID NO: 162; polynucleotides encoding the complementarity-determining regions (SEQ ID NO: 194; SEQ ID NO: 196; and SEQ ID NO: 198) of the light chain sequence of SEQ ID NO: 181 or the variable light chain sequence of SEQ ID NO: 182; polynucleotides encoding the framework regions (SEQ ID NO: 173; SEQ ID NO: 175; SEQ ID NO: 177; and SEQ ID NO: 179) of the heavy chain sequence of SEQ ID NO: 161 or the variable heavy chain sequence of SEQ ID NO: 162; and polynucleotides encoding the framework regions (SEQ ID NO: 193; SEQ ID NO: 195; SEQ ID NO: 197; and SEQ ID NO: 199) of the light chain sequence of SEQ ID NO: 181 or the variable light chain sequence of SEQ ID NO: 182.

In a preferred embodiment of the invention, polynucleotides of the invention comprise, or alternatively consist of, polynucleotides encoding Fab (fragment antigen binding) fragments having binding specificity for ACTH. With respect to antibody Ab2.H, the polynucleotides encoding the full length Ab2.H antibody comprise, or alternatively consist of, the polynucleotide SEQ ID NO: 171 encoding the heavy chain sequence of SEQ ID NO: 161 and the polynucleotide SEQ ID NO: 191 encoding the light chain sequence of SEQ ID NO: 181.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab2.H following expression of the full-length polynucleotides in a suitable host. In another embodiment of the invention, anti-ACTH antibodies such as Ab2.H or Fab fragments thereof may be produced via expression of Ab2.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab3.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 201:

(SEQ ID NO: 211)
gaggtgcagcttgtggagtctgggggaggcttggtccagcctggggggtc cctgagactctcctgtgcagcctctggttcctccctcagtaactttgaca tgatctgggtccgtcaggctccagggaaggggctggagtccatcggaatc atttatgattttggtagcacatactacgccagctctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagcgcctccaccaa gggcccatcggtcttccccctggcacctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggac cgtcagtcttcctcttcccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcagggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 202:

(SEQ ID NO: 212)
gaggtgcagcttgtggagtctgggggaggcttggtccagcctgggggtc cctgagactctcctgtgcagcctctggttcctccctcagtaactttgaca tgatctgggtccgtcaggctccagggaaggggctggagtccatcggaatc atttatgattttggtagcacatactacgccagctctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 210:

(SEQ ID NO: 220)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 221:

(SEQ ID NO: 231)
gacatccagatgacccagtctccttccaccctgtctgcatctgtaggaga cagagtcaccatcacttgtcaggccagtgaggatattagtagtaacttag cctggtatcagcagaaaccaggaaaagcccctaagctcctgatctattct gcatccactctggcatctggagtcccatcaaggttcagcggcagtggatc tggaacagaatttactctcaccatcagcagcctgcagcctgatgattttg caacttactactgtcaaagctatgatggtagtagtagtagttatggt attggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 222:

(SEQ ID NO: 232)
gacatccagatgacccagtctccttccaccctgtctgcatctgtaggaga cagagtcaccatcacttgtcaggccagtgaggatattagtagtaacttag cctggtatcagcagaaaccaggaaaagcccctaagctcctgatctattct gcatccactctggcatctggagtcccatcaaggttcagcggcagtggatc tggaacagaatttactctcaccatcagcagcctgcagcctgatgattttg caacttactactgtcaaagctatgatggtagtagtagtagttatggt attggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 230:

(SEQ ID NO: 240)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct -continued
acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 214; SEQ ID NO: 216; and SEQ ID NO: 218, which correspond to polynucleotides encoding the complementarity-determining regions (CDRs or hypervariable regions) of the heavy chain sequence of SEQ ID NO: 201 or the variable heavy chain sequence of SEQ ID NO: 202, and/or one or more of the polynucleotide sequences of SEQ ID NO: 234; SEQ ID NO: 236 and SEQ ID NO: 238, which correspond to the complementarity-determining regions (CDRs or hypervariable regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 213; SEQ ID NO: 215; SEQ ID NO: 217; and SEQ ID NO: 219, which correspond to polynucleotides encoding the framework regions (FRs or constant regions) of the heavy chain sequence of SEQ ID NO: 201 or the variable heavy chain sequence of SEQ ID NO: 202, and/or one or more of the polynucleotide sequences of SEQ ID NO: 233; SEQ ID NO: 235; SEQ ID NO: 237; and SEQ ID NO: 239, which correspond to the framework regions (FRs or constant regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 211 encoding the heavy chain sequence of SEQ ID NO: 201; the polynucleotide SEQ ID NO: 212 encoding the variable heavy chain sequence of SEQ ID NO: 202; the polynucleotide SEQ ID NO: 231 encoding the light chain sequence of SEQ ID NO: 221; the polynucleotide SEQ ID NO: 232 encoding the variable light chain sequence of SEQ ID NO: 222; polynucleotides encoding the complementarity-determining regions (SEQ ID NO: 214; SEQ ID NO: 216; and SEQ ID NO: 218) of the heavy chain sequence of SEQ ID NO: 201 or the variable heavy chain sequence of SEQ ID NO: 202; polynucleotides encoding the complementarity-determining regions (SEQ ID NO: 234; SEQ ID NO: 236; and SEQ ID NO: 238) of the light chain sequence of SEQ ID NO: 221 or the variable light chain sequence of SEQ ID NO: 222; polynucleotides encoding the framework regions (SEQ ID NO: 213; SEQ ID NO: 215; SEQ ID NO: 217; and SEQ ID NO: 219) of the heavy chain sequence of SEQ ID NO: 201 or the variable heavy chain sequence of SEQ ID NO: 202; and polynucleotides encoding the framework regions (SEQ ID NO: 233; SEQ ID NO: 235; SEQ ID NO: 237; and SEQ ID NO: 239) of the light chain sequence of SEQ ID NO: 221 or the variable light chain sequence of SEQ ID NO: 222.

In a preferred embodiment of the invention, polynucleotides of the invention comprise, or alternatively consist of, polynucleotides encoding Fab (fragment antigen binding) fragments having binding specificity for ACTH. With respect to antibody Ab3.H, the polynucleotides encoding the full length Ab3.H antibody comprise, or alternatively consist of, the polynucleotide SEQ ID NO: 211 encoding the heavy chain sequence of SEQ ID NO: 201 and the polynucleotide SEQ ID NO: 231 encoding the light chain sequence of SEQ ID NO: 221.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab3.H following expression of the full-length polynucleotides in a suitable host. In another embodiment of the invention, anti-ACTH antibodies such as Ab3.H or Fab fragments thereof may be produced via expression of Ab3.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab4.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 241:

(SEQ ID NO: 251)
gaggtgcagcttgtggagtctgggggaggcttggtccagcctgggggtc cctgagactctcctgtgcagcctctggattcaccgtcagtaagcatgaca tgatctgggtccgtcaggctccagggaaggggctggagtccatcggaatc atttatgatgatggtgatacatactacgctaattctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagcgcctccaccaa gggcccatcggtcttccccctggcacccctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggggac cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcggggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcagggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 242:

(SEQ ID NO: 252)
gaggtgcagcttgtggagtctgggggaggcttggtccagcctggggggtc cctgagactctcctgtgcagcctctggattcaccgtcagtaagcatgaca tgatctgggtccgtcaggctccagggaaggggctggagtccatcggaatc atttatgatgatggtgatacatactacgctaattctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 250:

(SEQ ID NO: 260)
gcctccaccaagggcccatcggtcttccccctggcaccctcctccaagag cacctctggggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcggggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 261:

(SEQ ID NO: 271)
gacatccagatgacccagtctccttccaccctgtctgcatctgtaggaga cagagtcaccatcacttgtagagccagtcagagcattagtgtctacctcg cctggtatcagcagaaaccaggaaaagcccctaagctcctgatctatcag gcatccaaactggcctctggagtcccatcaaggttcagcggcagtggatc tggaacagaattcactctcaccatcagcagcctgcagcctgatgattttg caacttactactgtcaaagctatgatggtagtagtagtagttatggt gttggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 262:

(SEQ ID NO: 272)
gacatccagatgacccagtctccttccaccctgtctgcatctgtaggaga cagagtcaccatcacttgtagagccagtcagagcattagtgtctacctcg cctggtatcagcagaaaccaggaaaagcccctaagctcctgatctatcag gcatccaaactggcctctggagtcccatcaaggttcagcggcagtggatc tggaacagaattcactctcaccatcagcagcctgcagcctgatgattttg caacttactactgtcaaagctatgatggtagtagtagtagttatggt gttggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 270:

```
                                            (SEQ ID NO: 280)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antibody fragments having binding specificity to ACTH comprise, or alternatively consist of, one or more of the polynucleotide sequences of SEQ ID NO: 254; SEQ ID NO: 256; and SEQ ID NO: 258, which correspond to polynucleotides encoding the complementarity-determining regions (CDRs or hypervariable regions) of the heavy chain sequence of SEQ ID NO: 241 or the variable heavy chain sequence of SEQ ID NO: 242, and/or one or more of the polynucleotide sequences of SEQ ID NO: 274; SEQ ID NO: 276 and SEQ ID NO: 278, which correspond to the complementarity-determining regions (CDRs or hypervariable regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 253; SEQ ID NO: 255; SEQ ID NO: 257; and SEQ ID NO: 259, which correspond to polynucleotides encoding the framework regions (FRs or constant regions) of the heavy chain sequence of SEQ ID NO: 241 or the variable heavy chain sequence of SEQ ID NO: 242, and/or one or more of the polynucleotide sequences of SEQ ID NO: 273; SEQ ID NO: 275; SEQ ID NO: 277; and SEQ ID NO: 279, which correspond to the framework regions (FRs or constant regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 251 encoding the heavy chain sequence of SEQ ID NO: 241; the polynucleotide SEQ ID NO: 252 encoding the variable heavy chain sequence of SEQ ID NO: 242; the polynucleotide SEQ ID NO: 271 encoding the light chain sequence of SEQ ID NO: 261; the polynucleotide SEQ ID NO: 272 encoding the variable light chain sequence of SEQ ID NO: 262; polynucleotides encoding the complementarity-determining regions (SEQ ID NO: 254; SEQ ID NO: 256; and SEQ ID NO: 258) of the heavy chain sequence of SEQ ID NO: 241 or the variable heavy chain sequence of SEQ ID NO: 242; polynucleotides encoding the complementarity-determining regions (SEQ ID NO: 274; SEQ ID NO: 276; and SEQ ID NO: 278) of the light chain sequence of SEQ ID NO: 261 or the variable light chain sequence of SEQ ID NO: 262; polynucleotides encoding the framework regions (SEQ ID NO: 253; SEQ ID NO: 255; SEQ ID NO: 257; and SEQ ID NO: 259) of the heavy chain sequence of SEQ ID NO: 241 or the variable heavy chain sequence of SEQ ID NO: 242; and polynucleotides encoding the framework regions (SEQ ID NO: 273; SEQ ID NO: 275; SEQ ID NO: 277; and SEQ ID NO: 279) of the light chain sequence of SEQ ID NO: 261 or the variable light chain sequence of SEQ ID NO: 262.

In a preferred embodiment of the invention, polynucleotides of the invention comprise, or alternatively consist of, polynucleotides encoding Fab (fragment antigen binding) fragments having binding specificity for ACTH. With respect to antibody Ab4.H, the polynucleotides encoding the full length Ab4.H antibody comprise, or alternatively consist of, the polynucleotide SEQ ID NO: 251 encoding the heavy chain sequence of SEQ ID NO: 241 and the polynucleotide SEQ ID NO: 271 encoding the light chain sequence of SEQ ID NO: 261.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab4.H following expression of the full-length polynucleotides in a suitable host. In another embodiment of the invention, anti-ACTH antibodies such as Ab4.H or Fab fragments thereof may be produced via expression of Ab4.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab6.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 281:

```
                                            (SEQ ID NO: 291)
gaggtgcagcttgtggagtctgggggaggcttggtccagcctgggggtc cctgagactctcctgtgcagcctctggattctccctcactgactatgcaa
```

-continued
tgagctgggtccgtcaggctccagggaaggggctggagtggatcggaatc attagtgatagtggtagcacatactacgctagctctgctaaaggccgatt caccatctccagagacaattccaagaacaccctgtatcttcaaatgaaca gcctgagagctgaggacactgctgtgtattactgtgctagagagcccgag tacggctacgatgagtatggtgattgggtttctgacttatggggccaagg gaccctcgtcaccgtctcgagcgcctccaccaagggcccatcggtcttcc ccctggcaccctcctccaagagcacctctgggggcacagcggccctggc tgcctggtcaaggactacttccccgaaccggtgacggtgtcgtggaactc aggcgccctgaccagcggcgtgcacaccttcccggctgtcctacagtcct caggactctactccctcagcagcgtggtgaccgtgccctccagcagcttg ggcacccagacctacatctgcaacgtgaatcacaagcccagcaacaccaa ggtggacgcgagagttgagcccaaatcttgtgacaaaactcacacatgcc caccgtgcccagcacctgaactcctgggggaccgtcagtcttcctcttc cccccaaaacccaaggacaccctcatgatctcccggacccctgaggtcac atgcgtggtggtggacgtgagccacgaagaccctgaggtcaagttcaact ggtacgtggacggcgtggaggtgcataatgccaagacaaagccgcgggag gagcagtacgccagcacgtaccgtgtggtcagcgtcctcaccgtcctgca ccaggactggctgaatggcaaggagtacaagtgcaaggtctccaacaaag ccctcccagccccatcgagaaaccatctccaaagccaaagggcagccc cgagaaccacaggtgtacaccctgcccccatcccgggaggagatgaccaa gaaccaggtcagcctgacctgcctggtcaaaggcttctatcccagcgaca tcgccgtggagtgggagagcaatgggcagccggagaacaactacaagacc acgcctcccgtgctggactccgacggctccttcttcctctacagcaagct caccgtggacaagagcaggtggcagcaggggaacgtcttctcatgctccg tgatgcatgaggctctgcacaaccactacacgcagaagagcctctccctg tctccgggtaaa.

In another embodiment of the invention, the polynucleotides of the invention comprise, or alternatively consist of, the following polynucleotide sequence encoding the variable heavy chain polypeptide sequence of SEQ ID NO: 282:

(SEQ ID NO: 292)
gaggtgcagcttgtggagtctgggggaggcttggtccagcctggggggtc cctgagactctcctgtgcagcctctggattctccctcactgactatgcaa tgagctgggtccgtcaggctccagggaaggggctggagtggatcggaatc attagtgatagtggtagcacatactacgctagctctgctaaaggccgatt caccatctccagagacaattccaagaacaccctgtatcttcaaatgaaca gcctgagagctgaggacactgctgtgtattactgtgctagagagcccgag tacggctacgatgagtatggtgattgggtttctgacttatggggccaagg gaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 290:

(SEQ ID NO: 300)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcccctcccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 301

(SEQ ID NO: 311)
gacatccagatgacccagtctccttccaccctgtctgcatctgtaggaga cagagtcaccatcacttgtcaggccactcagagcattggtaataacttag cctggtatcagcagaaaccaggaaaagcccctaagctcctgatctataga gcatccactctggcatctggagtcccatcaaggttcagcggcagtggatc tggaacagaattcactctcaccatcagcagcctgcagcctgatgattttg caacttactactgtcaaagctattactatagtagtagtattacttatcat aatgctttcggcggaggaaccaaggtggaaatcaaacgtacggtagcggc cccatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 302:

gacatccagatgacccagtctccttccaccctgtctgcatctgtaggagacagagt-
caccatcacttgtcaggccactcagagcattggtaataacttagcc tggtatca-
gcagaaaccaggaaaagcccctaagctcctgatctatagggcatccactctg-
gcatctggagtcccatcaaggttcagcggcagtggatctg
gaacagaattcactctcaccatcagcagcctgcagcctgatgattttgcaacttac-
tactgtcaaagctattactatagtagtagtattacttatcataatgctttc ggcggag-
gaaccaaggtggaaatcaaacgt (SEQ ID NO: 312).

In another embodiment of the invention, polynucleotides of the invention comprise, or alternatively consist of, the following polynucleotide sequence encoding the constant light chain polypeptide sequence of SEQ ID NO: 310:

(SEQ ID NO: 320)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 294; SEQ ID NO: 296; and SEQ ID NO: 298, which correspond to polynucleotides encoding the complementarity-determining regions (CDRs or hypervariable regions) of the heavy chain sequence of SEQ ID NO: 281 or the variable heavy chain sequence of SEQ ID NO: 282, and/or one or more of the polynucleotide sequences of SEQ ID NO: 314; SEQ ID NO: 316 and SEQ ID NO: 318, which correspond to the complementarity-determining regions (CDRs or hypervariable regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 293; SEQ ID NO: 295; SEQ ID NO: 297; and SEQ ID NO: 299, which correspond to polynucleotides encoding the framework regions (FRs or constant regions) of the heavy chain sequence of SEQ ID NO: 281 or the variable heavy chain sequence of SEQ ID NO: 282, and/or one or more of the polynucleotide sequences of SEQ ID NO: 313; SEQ ID NO: 315; SEQ ID NO: 317; and SEQ ID NO: 319, which correspond to the framework regions (FRs or constant regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 291 encoding the heavy chain sequence of SEQ ID NO: 281; the polynucleotide SEQ ID NO: 292 encoding the variable heavy chain sequence of SEQ ID NO: 282; the polynucleotide SEQ ID NO: 311 encoding the light chain sequence of SEQ ID NO: 301; the polynucleotide SEQ ID NO: 312 encoding the variable light chain sequence of SEQ ID NO: 302; polynucleotides encoding the complementarity-determining regions (SEQ ID NO: 294; SEQ ID NO: 296; and SEQ ID NO: 298) of the heavy chain sequence of SEQ ID NO: 281 or the variable heavy chain sequence of SEQ ID NO: 282; polynucleotides encoding the complementarity-determining regions (SEQ ID NO: 314; SEQ ID NO: 316; and SEQ ID NO: 318) of the light chain sequence of SEQ ID NO: 301 or the variable light chain sequence of SEQ ID NO: 302; polynucleotides encoding the framework regions (SEQ ID NO: 293; SEQ ID NO: 295; SEQ ID NO: 297; and SEQ ID NO: 299) of the heavy chain sequence of SEQ ID NO: 281 or the variable heavy chain sequence of SEQ ID NO: 282; and polynucleotides encoding the framework regions (SEQ ID NO: 313; SEQ ID NO: 315; SEQ ID NO: 317; and SEQ ID NO: 319) of the light chain sequence of SEQ ID NO: 301 or the variable light chain sequence of SEQ ID NO: 302.

In a preferred embodiment of the invention, polynucleotides of the invention comprise, or alternatively consist of, polynucleotides encoding Fab (fragment antigen binding) fragments having binding specificity for ACTH. With respect to antibody Ab6.H, the polynucleotides encoding the full length Ab6.H antibody comprise, or alternatively consist of, the polynucleotide SEQ ID NO: 291 encoding the heavy chain sequence of SEQ ID NO: 281 and the polynucleotide SEQ ID NO: 311 encoding the light chain sequence of SEQ ID NO: 301.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab6.H following expression of the full-length polynucleotides in a suitable host. In another embodiment of the invention, anti-ACTH antibodies such as Ab6.H or Fab fragments thereof may be produced via expression of Ab6.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab7.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 321:

(SEQ ID NO: 331)
gaggtgcagcttgtggagtctgggggaggcttggtccagcctggggggtc cctgagactctcctgtgcagcctctggattctccctcagtagctatgcaa tgagctgggtccgtcaggctccagggaaggggctggagtggatcggaatc attagtgatagtggtagcacatactacgcgagctctgctaaaggccgatt caccatctccagagacaattccaagaacaccctgtatcttcaaatgaaca gcctgagagctgaggacactgctgtgtattactgtgctagagagcccgag tacggctacgatgactatggtgattgggtttctgacttatggggccaagg gaccctcgtcaccgtctcgagcgcctccaccaagggcccatcggtcttcc ccctggcacctcctccaagagcacctctgggggcacagcggccctgggc tgcctggtcaaggactacttccccgaaccggtgacggtgtcgtggaactc aggcgccctgaccagcggcgtgcacaccttcccggctgtcctacagtcct caggactctactccctcagcagcgtggtgaccgtgccctccagcagcttg ggcacccagacctacatctgcaacgtgaatcacaagcccagcaacaccaa ggtggacgcgagagttgagcccaaatcttgtgacaaaactcacacatgcc caccgtgcccagcacctgaactcctggggggaccgtcagtcttcctcttc cccccaaaacccaaggacaccctcatgatctcccggacccctgaggtcac atgcgtggtggtggacgtgagccacgaagaccctgaggtcaagttcaact ggtacgtggacggcgtggaggtgcataatgccaagacaaagccgcgggag gagcagtacgccagcacgtaccgtgtggtcagcgtcctcaccgtcctgca ccaggactggctgaatggcaaggagtacaagtgcaaggtctccaacaaag ccctcccagcccccatcgagaaaaccatctccaaagccaaagggcagccc cgagaaccacaggtgtacaccctgcccccatcccgggaggagatgaccaa gaaccaggtcagcctgacctgcctggtcaaaggcttctatcccagcgaca tcgccgtggagtgggagagcaatgggcagccggagaacaactacaagacc acgcctcccgtgctggactccgacggctccttcttcctctacagcaagct caccgtggacaagagcaggtggcagcaggggaacgtcttctcatgctccg tgatgcatgaggctctgcacaaccactacacgcagaagagcctctccctg tctccgggtaaa.

In another embodiment of the invention, the polynucleotides of the invention comprise, or alternatively consist of, the following polynucleotide sequence encoding the variable heavy chain polypeptide sequence of SEQ ID NO: 322:

(SEQ ID NO: 332)
gaggtgcagcttgtggagtctgggggaggcttggtccagcctggggggtc cctgagactctcctgtgcagcctctggattctccctcagtagctatgcaa tgagctgggtccgtcaggctccagggaaggggctggagtggatcggaatc attagtgatagtggtagcacatactacgcgagctctgctaaaggccgatt caccatctccagagacaattccaagaacaccctgtatcttcaaatgaaca gcctgagagctgaggacactgctgtgtattactgtgctagagagcccgag tacggctacgatgactatggtgattgggtttctgacttatggggccaagg gaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 330:

(SEQ ID NO: 340)
gcctccaccaagggcccatcggtcttccccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 341:

(SEQ ID NO: 351)
gacatccagatgacccagtctccttccaccctgtctgcatctgtaggaga cagagtcaccatcacttgtcaggccagtcagagcattagtgattacttat cctggtatcagcagaaaccaggaaaagcccctaagctcctgatctatagg gcatccactctggcatctggagtcccatcaaggttcagcggcagtggatc tggaacagaattcactctcaccatcagcagcctgcagcctgatgattttg caacttactactgtcaaagctattactatagtagtagtattacttatcgt aatgctttcggcggaggaaccaaggtggaaatcaaacgtacggtagcggc cccatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag -continued
```
tgtcacagagcaggacagcaaggacagcacctacagcctcagcagcacc tgacgctgagcaaagcagactacgagaaacacaaagtctacgcctgcgaa gtcacccatcagggcctgagctcgcccgtcacaaagagcttcaacagggg agagtgt.
```

In another embodiment of the invention, polynucleotides of the invention comprise, or alternatively consist of, the following polynucleotide sequence encoding the variable light chain polypeptide sequence of SEQ ID NO: 342:

```
                                       (SEQ ID NO: 352)
gacatccagatgacccagtctccttccaccctgtctgcatctgtaggaga cagagtcaccatcacttgtcaggccagtcagagcattagtgattacttat cctggtatcagcagaaaccaggaaaagcccctaagctcctgatctatagg gcatccactctggcatctggagtcccatcaaggttcagcggcagtggatc tggaacagaattcactctcaccatcagcagcctgcagcctgatgattttg caacttactactgtcaaagctattactatagtagtagtattacttatcgt aatgctttcggcggaggaaccaaggtggaaatcaaacgt.
```

In another embodiment of the invention, polynucleotides of the invention comprise, or alternatively consist of, the following polynucleotide sequence encoding the constant light chain polypeptide sequence of SEQ ID NO: 350:

```
                                       (SEQ ID NO: 360)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antibody fragments having binding specificity to ACTH comprise, or alternatively consist of, one or more of the polynucleotide sequences of SEQ ID NO: 334; SEQ ID NO: 336; and SEQ ID NO: 338, which correspond to polynucleotides encoding the complementarity-determining regions (CDRs or hypervariable regions) of the heavy chain sequence of SEQ ID NO: 321 or the variable heavy chain sequence of SEQ ID NO: 322, and/or one or more of the polynucleotide sequences of SEQ ID NO: 354; SEQ ID NO: 356 and SEQ ID NO: 358, which correspond to the complementarity-determining regions (CDRs or hypervariable regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 333; SEQ ID NO: 335; SEQ ID NO: 337; and SEQ ID NO: 339, which correspond to polynucleotides encoding the framework regions (FRs or constant regions) of the heavy chain sequence of SEQ ID NO: 321 or the variable heavy chain sequence of SEQ ID NO: 322, and/or one or more of the polynucleotide sequences of SEQ ID NO: 353; SEQ ID NO: 355; SEQ ID NO: 357; and SEQ ID NO: 359, which correspond to the framework regions (FRs or constant regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 331 encoding the heavy chain sequence of SEQ ID NO: 321; the polynucleotide SEQ ID NO: 332 encoding the variable heavy chain sequence of SEQ ID NO: 322; the polynucleotide SEQ ID NO: 351 encoding the light chain sequence of SEQ ID NO: 341; the polynucleotide SEQ ID NO: 352 encoding the variable light chain sequence of SEQ ID NO: 342; polynucleotides encoding the complementarity-determining regions (SEQ ID NO: 334; SEQ ID NO: 336; and SEQ ID NO: 338) of the heavy chain sequence of SEQ ID NO: 321 or the variable heavy chain sequence of SEQ ID NO: 322; polynucleotides encoding the complementarity-determining regions (SEQ ID NO: 354; SEQ ID NO: 356; and SEQ ID NO: 358) of the light chain sequence of SEQ ID NO: 341 or the variable light chain sequence of SEQ ID NO: 342; polynucleotides encoding the framework regions (SEQ ID NO: 333; SEQ ID NO: 335; SEQ ID NO: 337; and SEQ ID NO: 339) of the heavy chain sequence of SEQ ID NO: 321 or the variable heavy chain sequence of SEQ ID NO: 322; and polynucleotides encoding the framework regions (SEQ ID NO: 353; SEQ ID NO: 355; SEQ ID NO: 357; and SEQ ID NO: 359) of the light chain sequence of SEQ ID NO: 341 or the variable light chain sequence of SEQ ID NO: 342.

In a preferred embodiment of the invention, polynucleotides of the invention comprise, or alternatively consist of, polynucleotides encoding Fab (fragment antigen binding) fragments having binding specificity for ACTH. With respect to antibody Ab7.H, the polynucleotides encoding the full length Ab7.H antibody comprise, or alternatively consist of, the polynucleotide SEQ ID NO: 331 encoding the heavy chain sequence of SEQ ID NO: 321 and the polynucleotide SEQ ID NO: 351 encoding the light chain sequence of SEQ ID NO: 341.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab7.H following expression of the full-length polynucleotides in a suitable host. In another embodiment of the invention, anti-ACTH antibodies such as Ab7.H or Fab fragments thereof may be produced via expression of Ab7.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab7A.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 361:

(SEQ ID NO: 371)
gaggtgcagcttgtggagtctgggggaggcttggtccagcctggggggtc cctgagactctcctgtgcagcctctggattctccctcagtagctatgcaa tgagctgggtccgtcaggctccagggaaggggctggagtggatcggaatc attagtgatagtggtagcacatactacgcgagctctgctaaaggccgatt caccatctccagagacaattccaagaacaccctgtatcttcaaatgaaca gcctgagagctgaggacactgctgtgtattactgtgctagagagcccgag tacggctacgatgactatggtgattgggtttctgacttatggggccaagg gaccctcgtcaccgtctcgagcgcctccaccaagggcccatcggtcttcc ccctggcaccctcctccaagagcacctctgggggcacagcggccctgggc tgcctggtcaaggactacttccccgaaccggtgacggtgtcgtggaactc aggcgccctgaccagcggcgtgcacaccttcccggctgtcctacagtcct caggactctactccctcagcagcgtggtgaccgtgccctccagcagcttg ggcacccagacctacatctgcaacgtgaatcacaagcccagcaacaccaa ggtggacgcgagagttgagcccaaatcttgtgacaaaactcacacatgcc caccgtgcccagcacctgaactcctgggggaccgtcagtcttcctcttc cccccaaaacccaaggacaccctcatgatctcccggacccctgaggtcac atgcgtggtggtggacgtgagccacgaagaccctgaggtcaagttcaact ggtacgtggacggcgtggaggtgcataatgccaagacaaagccgcgggag gagcagtacgccagcacgtaccgtgtggtcagcgtcctcaccgtcctgca ccaggactggctgaatggcaaggagtacaagtgcaaggtctccaacaaag ccctcccagcccccatcgagaaaaccatctccaaagccaaagggcagccc cgagaaccacaggtgtacaccctgcccccatcccgggaggagatgaccaa gaaccaggtcagcctgacctgcctggtcaaaggcttctatcccagcgaca tcgccgtggagtgggagagcaatgggcagccggagaacaactacaagacc acgcctcccgtgctggactccgacggctccttcttcctctacagcaagct caccgtggacaagagcaggtggcagcaggggaacgtcttctcatgctccg tgatgcatgaggctctgcacaaccactacacgcagaagagcctctccctg tctccgggtaaa.

In another embodiment of the invention, the polynucleotides of the invention comprise, or alternatively consist of, the following polynucleotide sequence encoding the variable heavy chain polypeptide sequence of SEQ ID NO: 362:

(SEQ ID NO: 372)
gaggtgcagcttgtggagtctgggggaggcttggtccagcctggggggtc cctgagactctcctgtgcagcctctggattctccctcagtagctatgcaa tgagctgggtccgtcaggctccagggaaggggctggagtggatcggaatc attagtgatagtggtagcacatactacgcgagctctgctaaaggccgatt caccatctccagagacaattccaagaacaccctgtatcttcaaatgaaca gcctgagagctgaggacactgctgtgtattactgtgctagagagcccgag tacggctacgatgactatggtgattgggtttctgacttatggggccaagg gaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 370:

(SEQ ID NO: 380)
gcctccaccaagggcccatcggtcttcccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttcccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 381:

(SEQ ID NO: 391)
gctgacatccagatgacccagtctccttccaccctgtctgcatctgtagg agacagagtcaccatcacttgtcaggccagtcagagcattagtgattact -continued
```
tatcctggtatcagcagaaaccaggaaaagcccctaagctcctgatctat agggcatccactctggcatctggagtcccatcaaggttcagcggcagtgg atctggaacagaattcactctcaccatcagcagcctgcagcctgatgatt ttgcaacttactactgtcaaagctattactatagtagtagtattacttat cgtaatgctttcggcggaggaaccaaggtggaaatcaaacgtacggtagc ggccccatctgtcttcatcttcccgccatctgatgagcagttgaaatctg gaactgcctctgttgtgtgcctgctgaataacttctatcccagagaggcc aaagtacagtggaaggtggataacgccctccaatcgggtaactcccagga gagtgtcacagagcaggacagcaaggacagcacctacagcctcagcagca ccctgacgctgagcaaagcagactacgagaaacacaaagtctacgcctgc gaagtcacccatcagggcctgagctcgcccgtcacaaagagcttcaacag gggagagtgt.
```

In another embodiment of the invention, polynucleotides of the invention comprise, or alternatively consist of, the following polynucleotide sequence encoding the variable light chain polypeptide sequence of SEQ ID NO: 382:

(SEQ ID NO: 392)
```
gctgacatccagatgacccagtctccttccaccctgtctgcatctgtagg agacagagtcaccatcacttgtcaggccagtcagagcattagtgattact tatcctggtatcagcagaaaccaggaaaagcccctaagctcctgatctat agggcatccactctggcatctggagtcccatcaaggttcagcggcagtgg atctggaacagaattcactctcaccatcagcagcctgcagcctgatgatt ttgcaacttactactgtcaaagctattactatagtagtagtattacttat cgtaatgctttcggcggaggaaccaaggtggaaatcaaacgt.
```

In another embodiment of the invention, polynucleotides of the invention comprise, or alternatively consist of, the following polynucleotide sequence encoding the constant light chain polypeptide sequence of SEQ ID NO: 390:

(SEQ ID NO: 400)
```
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antibody fragments having binding specificity to ACTH comprise, or alternatively consist of, one or more of the polynucleotide sequences of SEQ ID NO: 374; SEQ ID NO: 376; and SEQ ID NO: 378, which correspond to polynucleotides encoding the complementarity-determining regions (CDRs or hypervariable regions) of the heavy chain sequence of SEQ ID NO: 361 or the variable heavy chain sequence of SEQ ID NO: 362, and/or one or more of the polynucleotide sequences of SEQ ID NO: 394; SEQ ID NO: 396 and SEQ ID NO: 398, which correspond to the complementarity-determining regions (CDRs or hypervariable regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 373; SEQ ID NO: 375; SEQ ID NO: 377; and SEQ ID NO: 379, which correspond to polynucleotides encoding the framework regions (FRs or constant regions) of the heavy chain sequence of SEQ ID NO: 361 or the variable heavy chain sequence of SEQ ID NO: 362, and/or one or more of the polynucleotide sequences of SEQ ID NO: 393; SEQ ID NO: 395; SEQ ID NO: 397; and SEQ ID NO: 399, which correspond to the framework regions (FRs or constant regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 371 encoding the heavy chain sequence of SEQ ID NO: 361; the polynucleotide SEQ ID NO: 372 encoding the variable heavy chain sequence of SEQ ID NO: 362; the polynucleotide SEQ ID NO: 391 encoding the light chain sequence of SEQ ID NO: 381; the polynucleotide SEQ ID NO: 392 encoding the variable light chain sequence of SEQ ID NO: 382; polynucleotides encoding the complementarity-determining regions (SEQ ID NO: 374; SEQ ID NO: 376; and SEQ ID NO: 378) of the heavy chain sequence of SEQ ID NO: 361 or the variable heavy chain sequence of SEQ ID NO: 362; polynucleotides encoding the complementarity-determining regions (SEQ ID NO: 394; SEQ ID NO: 396; and SEQ ID NO: 398) of the light chain sequence of SEQ ID NO: 381 or the variable light chain sequence of SEQ ID NO: 382; polynucleotides encoding the framework regions (SEQ ID NO: 373; SEQ ID NO: 375; SEQ ID NO: 377; and SEQ ID NO: 379) of the heavy chain sequence of SEQ ID NO: 361 or the variable heavy chain sequence of SEQ ID NO: 362; and polynucleotides encoding the framework regions (SEQ ID NO: 393; SEQ ID NO: 395; SEQ ID NO: 397; and SEQ ID NO: 399) of the light chain sequence of SEQ ID NO: 381 or the variable light chain sequence of SEQ ID NO: 382.

In a preferred embodiment of the invention, polynucleotides of the invention comprise, or alternatively consist of, polynucleotides encoding Fab (fragment antigen binding) fragments having binding specificity for ACTH. With respect to antibody Ab7A.H, the polynucleotides encoding the full length Ab7A.H antibody comprise, or alternatively consist of, the polynucleotide SEQ ID NO: 371 encoding the heavy chain sequence of SEQ ID NO: 361 and the polynucleotide SEQ ID NO: 391 encoding the light chain sequence of SEQ ID NO: 381.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab7A.H following expression of the full-length polynucleotides in a suitable host. In another embodiment of the invention, anti-ACTH antibodies such as Ab7A.H or Fab fragments thereof may be produced via expression of Ab7A.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab10.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 401:

(SEQ ID NO: 411)
gaggtgcagcttgtggagtctgggggaggcttggtccagcctgggggtc cctgagactctcctgtgcagcctctggattcaccgtcagtagcgctgaca tgatctgggtccgtcaggctccagggaaggggctggagtccatcggaatg atttatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt agtgtctggggccaagggaccctcgtcaccgtctcgagcgcctccaccaa gggcccatcggtcttccccctggcaccctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctgggggga cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcaggggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 402:

(SEQ ID NO: 412)
gaggtgcagcttgtggagtctgggggaggcttggtccagcctgggggtc cctgagactctcctgtgcagcctctggattcaccgtcagtagcgctgaca tgatctgggtccgtcaggctccagggaaggggctggagtccatcggaatg atttatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt agtgtctggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 410.

(SEQ ID NO: 420)
gcctccaccaagggcccatcggtcttccccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg -continued
acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 421:

(SEQ ID NO: 431)
gacatccagatgacccagtctccttccaccctgtctgcatctgtaggaga cagagtcaccatcacttgtcaggccagtgagaacatttacaggtctttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtagtagtagttatggt gttggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 422:

(SEQ ID NO: 432)
gacatccagatgacccagtctccttccaccctgtctgcatctgtaggaga cagagtcaccatcacttgtcaggccagtgagaacatttacaggtctttag cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtagtagtagttatggt gttggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 430:

(SEQ ID NO: 440)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 414; SEQ ID NO: 416; and SEQ ID NO: 418, which correspond to polynucleotides encoding the complementarity-determining regions (CDRs or hypervariable regions) of the heavy chain sequence of SEQ ID NO: 401 or the variable heavy chain sequence of SEQ ID NO: 402, and/or one or more of the polynucleotide sequences of SEQ ID NO: 434; SEQ ID NO: 436 and SEQ ID NO: 438, which correspond to the complementarity-determining regions (CDRs or hypervariable regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 413; SEQ ID NO: 415; SEQ ID NO: 417; and SEQ ID NO: 419, which correspond to polynucleotides encoding the framework regions (FRs or constant regions) of the heavy chain sequence of SEQ ID NO: 401 or the variable heavy chain sequence of SEQ ID NO: 402, and/or one or more of the polynucleotide sequences of SEQ ID NO: 433; SEQ ID NO: 435; SEQ ID NO: 437; and SEQ ID NO: 439, which correspond to the framework regions (FRs or constant regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 411 encoding the heavy chain sequence of SEQ ID NO: 401; the polynucleotide SEQ ID NO: 412 encoding the variable heavy chain sequence of SEQ ID NO: 402; the polynucleotide SEQ ID NO: 431 encoding the light chain sequence of SEQ ID NO: 421; the polynucleotide SEQ ID NO: 432 encoding the variable light chain sequence of SEQ ID NO: 422; polynucleotides encoding the complementarity-determining regions (SEQ ID NO: 414; SEQ ID NO: 416; and SEQ ID NO: 418) of the heavy chain sequence of SEQ ID NO: 401 or the variable heavy chain sequence of SEQ ID NO: 402; polynucleotides encoding the complementarity-determining regions (SEQ ID NO: 434; SEQ ID NO: 436; and SEQ ID NO: 438) of the light chain sequence of SEQ ID NO: 421 or the variable light chain sequence of SEQ ID NO: 422; polynucleotides encoding the framework regions (SEQ ID NO: 413; SEQ ID NO: 415; SEQ ID NO: 417; and SEQ ID NO: 419) of the heavy chain sequence of SEQ ID NO: 401 or the variable heavy chain sequence of SEQ ID NO: 402; and polynucleotides encoding the framework regions (SEQ ID NO: 433; SEQ ID NO: 435; SEQ ID NO: 437; and SEQ ID NO: 439) of the light chain sequence of SEQ ID NO: 421 or the variable light chain sequence of SEQ ID NO: 422.

In a preferred embodiment of the invention, polynucleotides of the invention comprise, or alternatively consist of, polynucleotides encoding Fab (fragment antigen binding) fragments having binding specificity for ACTH. With respect to antibody Ab10.H, the polynucleotides encoding the full length Ab10.H antibody comprise, or alternatively consist of, the polynucleotide SEQ ID NO: 411 encoding the heavy chain sequence of SEQ ID NO: 401 and the polynucleotide SEQ ID NO: 431 encoding the light chain sequence of SEQ ID NO: 421.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab10.H following expression of the full-length polynucleotides in a suitable host. In another embodiment of the invention, anti-ACTH antibodies such as Ab10.H or Fab fragments thereof may be produced via expression of Ab10.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab11.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 441:

(SEQ ID NO: 451)
gaggtgcagcttgtggagtctgggggaggcttggtccagcctggggggtc
cctgagactctcctgtgcagcctctggattcaccgtcagtgcctatgaca
tcctctgggtccgtcaggctccagggaaggggctggagtccatcggaatg
atgtatgatgatggtgacacatactacgctacttctgctaaaggccgatt
caccatctccagagacaattccaagaacaccctgtatcttcaaatgaaca
gcctgagagctgaggacactgctgtgtattactgtgtcaaaggtgtgagt
aatatctggggccaagggaccctcgtcaccgtctcgagcgcctccaccaa
gggcccatcggtcttccccctggcaccctcctccaagagcacctctgggg
gcacagcggccctgggctgcctggtcaaggactacttccccgaaccggtg
acggtgtcgtggaactcaggcgccctgaccagcggcgtgcacaccttccc ggctgtcctacagtcctcaggactctactccctcagcagcgtggtgaccg
tgccctccagcagcttgggcacccagacctacatctgcaacgtgaatcac
aagcccagcaacaccaaggtggacgcgagagttgagcccaaatcttgtga
caaaactcacacatgcccaccgtgcccagcacctgaactcctgggggga
cgtcagtcttcctcttccccccaaaacccaaggacaccctcatgatctcc
cggacccctgaggtcacatgcgtggtggtggacgtgagccacgaagaccc
tgaggtcaagttcaactggtacgtggacggcgtggaggtgcataatgcca
agacaaagccgcgggaggagcagtacgccagcacgtaccgtgtggtcagc
gtcctcaccgtcctgcaccaggactggctgaatggcaaggagtacaagtg
caaggtctccaacaaagccctcccagcccccatcgagaaaaccatctcca
aagccaaagggcagccccgagaaccacaggtgtacaccctgcccccatcc
cgggaggagatgaccaagaaccaggtcagcctgacctgcctggtcaaagg
cttctatcccagcgacatcgccgtggagtgggagagcaatgggcagccgg
agaacaactacaagaccacgcctcccgtgctggactccgacggctccttc
ttcctctacagcaagctcaccgtggacaagagcaggtggcagcaggggaa
cgtcttctcatgctccgtgatgcatgaggctctgcacaaccactacacgc
agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 442:
gaggtgcagcttgtggagtctgggggaggcttggtccagcctggggggtccct-gagactctcctgtgcagcctctggattcaccgtcagtgcctatgaca tcctctgggtc-cgtcaggctccagggaagggctggagtccatcggaatgatgtatgatgatggt-gacacatactacgctacttctgctaaaggccgattc accatctccagagacaattccaagaacaccctgtatcttcaaatgaacagcct-gagagctgaggacactgctgtgtattactgtgtcaaaggtgtgagtaat atctggggccaagggaccctcgtcaccgtctcgagc (SEQ ID NO: 452).

In another embodiment of the invention, polynucleotides of the invention comprise, or alternatively consist of, the following polynucleotide sequence encoding the constant heavy chain polypeptide sequence of SEQ ID NO: 450:

(SEQ ID NO: 460)
gcctccaccaagggcccatcggtcttccccctggcaccctcctccaagag
cacctctgggggcacagcggccctgggctgcctggtcaaggactacttcc
ccgaaccggtgacggtgtcgtggaactcaggcgccctgaccagcggcgtg
cacaccttcccggctgtcctacagtcctcaggactctactccctcagcag
cgtggtgaccgtgccctccagcagcttgggcacccagacctacatctgca
acgtgaatcacaagcccagcaacaccaaggtggacgcgagagttgagccc
aaatcttgtgacaaaactcacacatgcccaccgtgcccagcacctgaact
cctgggggaccgtcagtcttcctcttccccccaaaacccaaggacaccc
tcatgatctcccggacccctgaggtcacatgcgtggtggtggacgtgagc
cacgaagacctgaggtcaagttcaactggtacgtggacggcgtggaggt
gcataatgccaagacaaagccgcgggaggagcagtacgccagcacgtacc
gtgtggtcagcgtcctcaccgtcctgcaccaggactggctgaatggcaag -continued
gagtacaagtgcaaggtctccaacaaagccctcccagccccatcgagaa aaccatctccaaagccaaagggcagccccgagaaccacaggtgtacaccc tgcccccatcccggggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 461:

(SEQ ID NO: 471)
gacatccagatgacccagtctccttccaccctgtctgcatctgtaggaga cagagtcaccatcacttgtcaggccagtcagagcattgatagtagcttgg cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtagtagttactatggt attggtttcggcggaggaaccaaggtggaaatcaaacgtacggtggctgc accatctgtcttcatcttcccgccatctgatgagcagttgaaatctggaa ctgcctctgttgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 462:

(SEQ ID NO: 472)
gacatccagatgacccagtctccttccaccctgtctgcatctgtaggaga cagagtcaccatcacttgtcaggccagtcagagcattgatagtagcttgg cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgatggtagtagtagtagttactatggt attggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 470:

(SEQ ID NO: 480)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 454; SEQ ID NO: 456; and SEQ ID NO: 458, which correspond to polynucleotides encoding the complementarity-determining regions (CDRs or hypervariable regions) of the heavy chain sequence of SEQ ID NO: 441 or the variable heavy chain sequence of SEQ ID NO: 442, and/or one or more of the polynucleotide sequences of SEQ ID NO: 474; SEQ ID NO: 476 and SEQ ID NO: 478, which correspond to the complementarity-determining regions (CDRs or hypervariable regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 453; SEQ ID NO: 455; SEQ ID NO: 457; and SEQ ID NO: 459, which correspond to polynucleotides encoding the framework regions (FRs or constant regions) of the heavy chain sequence of SEQ ID NO: 441 or the variable heavy chain sequence of SEQ ID NO: 442, and/or one or more of the polynucleotide sequences of SEQ ID NO: 473; SEQ ID NO: 475; SEQ ID NO: 477; and SEQ ID NO: 479, which correspond to the framework regions (FRs or constant regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 451 encoding the heavy chain sequence of SEQ ID NO: 441; the polynucleotide SEQ ID NO: 452 encoding the variable heavy chain sequence of SEQ ID NO: 442; the polynucleotide SEQ ID NO: 471 encoding the light chain sequence of SEQ ID NO: 461; the polynucleotide SEQ ID NO: 472 encoding the variable light chain sequence of SEQ ID NO: 462; polynucleotides encoding the complementarity-determining regions (SEQ ID NO: 454; SEQ ID NO: 456; and SEQ ID NO: 458) of the heavy chain sequence of SEQ ID NO: 441 or the variable heavy chain sequence of SEQ ID NO: 442; polynucleotides encoding the complementarity-determining regions (SEQ ID NO: 474; SEQ ID NO: 476; and SEQ ID NO: 478) of the light chain sequence of SEQ ID NO: 461 or the variable light chain sequence of SEQ ID NO: 462; polynucleotides encoding the framework regions (SEQ ID NO: 453; SEQ ID NO: 455; SEQ ID NO: 457; and SEQ ID NO: 459) of the heavy chain sequence of SEQ ID NO: 441 or the variable heavy chain sequence of SEQ ID NO: 442; and polynucleotides encoding the framework regions (SEQ ID NO: 473; SEQ ID NO: 475; SEQ ID NO: 477; and SEQ ID NO: 479) of the light chain sequence of SEQ ID NO: 461 or the variable light chain sequence of SEQ ID NO: 462.

In a preferred embodiment of the invention, polynucleotides of the invention comprise, or alternatively consist of, polynucleotides encoding Fab (fragment antigen binding) fragments having binding specificity for ACTH. With respect to antibody Ab11.H, the polynucleotides encoding the full length Ab11.H antibody comprise, or alternatively consist of, the polynucleotide SEQ ID NO: 451 encoding the heavy chain sequence of SEQ ID NO: 441 and the polynucleotide SEQ ID NO: 471 encoding the light chain sequence of SEQ ID NO: 461.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab11.H following expression of the full-length polynucleotides in a suitable host. In another embodiment of the invention, anti-ACTH antibodies such as Ab11.H or Fab fragments thereof may be produced via expression of Ab11.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab11A.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 481:

(SEQ ID NO: 491)
gaggtgcagcttgtggagtctgggggaggcttggtccagcctggggggtc cctgagactctcctgtgcagcctctggattcaccgtcagtgcctatgaca tcctctgggtccgtcaggctccagggaaggggctggagtccatcggaatg atgtatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagcgcctccaccaa gggcccatcggtcttcccctggcaccctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacaagaaagttgagcccaaatcttgtga caaaactcacacatgcccaccgtgcccagcacctgaactcctgggggac cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcaggggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 482:

(SEQ ID NO: 492)
gaggtgcagcttgtggagtctgggggaggcttggtccagcctggggggtc cctgagactctcctgtgcagcctctggattcaccgtcagtgcctatgaca tcctctgggtccgtcaggctccagggaaggggctggagtccatcggaatg atgtatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt aatatctggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 490:

(SEQ ID NO: 500)
gcctccaccaagggcccatcggtcttcccctggcaccctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag -continued cgtggtgaccgtgccctccagcagcttgggcacccagacctacatctgca acgtgaatcacaagcccagcaacaccaaggtggacaagaaagttgagccc aaatcttgtgacaaaactcacacatgcccaccgtgcccagcacctgaact cctgggggaccgtcagtcttcctcttcccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcccccagccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcagggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 501:

(SEQ ID NO: 511)
gacatccagatgacccagtctccttccaccctgtctgcatctgtaggaga cagagtcaccatcacttgtcaggccagtcagagcattggtagtagcttgg cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgaaggtagtagtagtagttactatggt attggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 502:

(SEQ ID NO: 512)
gacatccagatgacccagtctccttccaccctgtctgcatctgtaggaga cagagtcaccatcacttgtcaggccagtcagagcattggtagtagcttgg cctggtatcagcagaaaccaggaaaagcccctaagctcctgatctattct gcatccactctggcatctggagtcccatcaaggttcagcggcagtggatc tggaacagaattcactctcaccatcagcagcctgcagcctgatgattttg caacttactactgtcaaagctatgaaggtagtagtagtagttactatggt attggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 510:

(SEQ ID NO: 520)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 494; SEQ ID NO: 496; and SEQ ID NO: 498, which correspond to polynucleotides encoding the complementarity-determining regions (CDRs or hypervariable regions) of the heavy chain sequence of SEQ ID NO: 481 or the variable heavy chain sequence of SEQ ID NO: 482, and/or one or more of the polynucleotide sequences of SEQ ID NO: 514; SEQ ID NO: 516 and SEQ ID NO: 518, which correspond to the complementarity-determining regions (CDRs or hypervariable regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 493; SEQ ID NO: 495; SEQ ID NO: 497; and SEQ ID NO: 499, which correspond to polynucleotides encoding the framework regions (FRs or constant regions) of the heavy chain sequence of SEQ ID NO: 481 or the variable heavy chain sequence of SEQ ID NO: 482, and/or one or more of the polynucleotide sequences of SEQ ID NO: 513; SEQ ID NO: 515; SEQ ID NO: 517; and SEQ ID NO: 519, which correspond to the framework regions (FRs or constant regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 491 encoding the heavy chain sequence of SEQ ID NO: 481; the polynucleotide SEQ ID NO: 492 encoding the variable heavy chain sequence of SEQ ID NO: 482; the polynucleotide SEQ ID NO: 511 encoding the light chain sequence of SEQ ID NO: 501; the polynucleotide SEQ ID NO: 512 encoding the variable light chain sequence of SEQ ID NO: 502; polynucleotides encoding the complementarity-determining regions (SEQ ID NO: 494; SEQ ID NO: 496; and SEQ ID NO: 498) of the heavy chain sequence of SEQ ID NO: 481 or the variable heavy chain sequence of SEQ ID NO: 482; polynucleotides encoding the complementarity-determining regions (SEQ ID NO: 514; SEQ ID NO: 516; and SEQ ID NO: 518) of the light chain sequence of SEQ ID NO: 501 or the variable light chain sequence of SEQ ID NO: 502; polynucleotides encoding the framework regions (SEQ ID NO: 493; SEQ ID NO: 495; SEQ ID NO: 497; and SEQ ID NO: 499) of the heavy chain sequence of SEQ ID NO: 481 or the variable heavy chain sequence of SEQ ID NO: 482; and polynucleotides encoding the framework regions (SEQ ID NO: 513; SEQ ID NO: 515; SEQ ID NO: 517; and SEQ ID NO: 519) of the light chain sequence of SEQ ID NO: 501 or the variable light chain sequence of SEQ ID NO: 502.

In a preferred embodiment of the invention, polynucleotides of the invention comprise, or alternatively consist of, polynucleotides encoding Fab (fragment antigen binding) fragments having binding specificity for ACTH. With respect to antibody Ab1A.H, the polynucleotides encoding the full length Ab11A.H antibody comprise, or alternatively consist of, the polynucleotide SEQ ID NO: 491 encoding the heavy chain sequence of SEQ ID NO: 481 and the polynucleotide SEQ ID NO: 511 encoding the light chain sequence of SEQ ID NO: 501.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab1A.H following expression of the full-length polynucleotides in a suitable host. In another embodiment of the invention, anti-ACTH antibodies such as Ab11A.H or Fab fragments thereof may be produced via expression of Ab11A.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab12.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 521:

(SEQ ID NO: 531)
gaggtgcagcttgtggagtctgggggaggcttggtccagcctggggggtc cctgagactctcctgtgcagcctctggatcctccctcagtgattatgaca tgatctgggtccgtcaggctccagggaaggggctggagtccatcggaatc atttatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt aatatgtggggccaagggaccctcgtcaccgtctcgagcgcctccaccaa gggcccatcggtcttccccctggcaccctcctccaagagcacctctgggg gcacagcggccctgggctgcctggtcaaggactacttccccgaaccggtg acggtgtcgtggaactcaggcgccctgaccagcggcgtgcacaccttccc ggctgtcctacagtcctcaggactctactccctcagcagcgtggtgaccg tgccctccagcagcttgggcacccagacctacatctgcaacgtgaatcac aagcccagcaacaccaaggtggacgcgagagttgagcccaaatcttgtga caaaactcacacatgcccaccgtgcccagcacctgaactcctggggggac cgtcagtcttcctcttccccccaaaacccaaggacaccctcatgatctcc cggacccctgaggtcacatgcgtggtggtggacgtgagccacgaagaccc tgaggtcaagttcaactggtacgtggacggcgtggaggtgcataatgcca agacaaagccgcgggaggagcagtacgccagcacgtaccgtgtggtcagc gtcctcaccgtcctgcaccaggactggctgaatggcaaggagtacaagtg caaggtctccaacaaagccctcccagcccccatcgagaaaaccatctcca aagccaaagggcagccccgagaaccacaggtgtacaccctgcccccatcc cgggaggagatgaccaagaaccaggtcagcctgacctgcctggtcaaagg cttctatcccagcgacatcgccgtggagtgggagagcaatgggcagccgg agaacaactacaagaccacgcctcccgtgctggactccgacggctccttc ttcctctacagcaagctcaccgtggacaagagcaggtggcagcagggggaa cgtcttctcatgctccgtgatgcatgaggctctgcacaaccactacacgc agaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 522:

(SEQ ID NO: 532)
gaggtgcagcttgtggagtctgggggaggcttggtccagcctggggggtc cctgagactctcctgtgcagcctctggatcctccctcagtgattatgaca tgatctgggtccgtcaggctccagggaaggggctggagtccatcggaatc atttatgatgatggtgacacatactacgctacttctgctaaaggccgatt caccatctccagagacaattccaagaacaccctgtatcttcaaatgaaca gcctgagagctgaggacactgctgtgtattactgtgtcaaaggtgtgagt aatatgtggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 530:

(SEQ ID NO: 540)
gcctccaccaagggcccatcggtcttccccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctgggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 541:

(SEQ ID NO: 551)
gacatccagatgacccagtctccttccaccctgtctgcatctgtaggaga cagagtcaccatcacttgtcaggccagtcagagcattggtagtagcttag cctggtatcagcagaaaccaggaaaagcccctaagctcctgatctatgct gcatccactctggcatctggagtcccatcaaggttcagcggcagtggatc tggaacagaattcactctcaccatcagcagcctgcagcctgatgattttg caacttactactgtcaaagctatgatggtagtagtagtagtagttatggt gttggtttcggcggaggaaccaaggtggaaatcaaacgtacggtggctgc accatctgtcttcatcttcccgccatctgatgagcagttgaaatctggaa ctgcctctgttgtgtgcctgctgaataacttctatcccagagaggccaaa gtacagtggaaggtggataacgccctccaatcgggtaactcccaggagag tgtcacagagcaggacagcaaggacagcacctacagcctcagcagcaccc tgacgctgagcaaagcagactacgagaaacacaaagtctacgcctgcgaa gtcacccatcagggcctgagctcgcccgtcacaaagagcttcaacagggg agagtgt.

In another embodiment of the invention, polynucleotides of the invention comprise, or alternatively consist of, the following polynucleotide sequence encoding the variable light chain polypeptide sequence of SEQ ID NO: 542:

(SEQ ID NO: 552)
gacatccagatgacccagtctccttccaccctgtctgcatctgtaggaga cagagtcaccatcacttgtcaggccagtcagagcattggtagtagcttag cctggtatcagcagaaaccaggaaaagcccctaagctcctgatctatgct gcatccactctggcatctggagtcccatcaaggttcagcggcagtggatc tggaacagaattcactctcaccatcagcagcctgcagcctgatgattttg caacttactactgtcaaagctatgatggtagtagtagtagtagttatggt gttggtttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 550:

(SEQ ID NO: 560)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 534; SEQ ID NO: 536; and SEQ ID NO: 538, which correspond to polynucleotides encoding the complementarity-determining regions (CDRs or hypervariable regions) of the heavy chain sequence of SEQ ID NO: 521 or the variable heavy chain sequence of SEQ ID NO: 522, and/or one or more of the polynucleotide sequences of SEQ ID NO: 554; SEQ ID NO: 556 and SEQ ID NO: 558, which correspond to the complementarity-determining regions (CDRs or hypervariable regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 533; SEQ ID NO: 535; SEQ ID NO: 537; and SEQ ID NO: 539, which correspond to polynucleotides encoding the framework regions (FRs or constant regions) of the heavy chain sequence of SEQ ID NO: 521 or the variable heavy chain sequence of SEQ ID NO: 522, and/or one or more of the polynucleotide sequences of SEQ ID NO: 553; SEQ ID NO: 555; SEQ ID NO: 557; and SEQ ID NO: 559, which correspond to the framework regions (FRs or constant regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 531 encoding the heavy chain sequence of SEQ ID NO: 521; the polynucleotide SEQ ID NO: 532 encoding the variable heavy chain sequence of SEQ ID NO: 522; the polynucleotide SEQ ID NO: 551 encoding the light chain sequence of SEQ ID NO: 541; the polynucleotide SEQ ID NO: 552 encoding the variable light chain sequence of SEQ ID NO: 542; polynucleotides encoding the complementarity-determining regions (SEQ ID NO: 534; SEQ ID NO: 536; and SEQ ID NO: 538) of the heavy chain sequence of SEQ ID NO: 521 or the variable heavy chain sequence of SEQ ID NO: 522; polynucleotides encoding the complementarity-determining regions (SEQ ID NO: 554; SEQ ID NO: 556; and SEQ ID NO: 558) of the light chain sequence of SEQ ID NO: 541 or the variable light chain sequence of SEQ ID NO: 542; polynucleotides encoding the framework regions (SEQ ID NO: 533; SEQ ID NO: 535; SEQ ID NO: 537; and SEQ ID NO: 539) of the heavy chain sequence of SEQ ID NO: 521 or the variable heavy chain sequence of SEQ ID NO: 522; and polynucleotides encoding the framework regions (SEQ ID NO: 553; SEQ ID NO: 555; SEQ ID NO: 557; and SEQ ID NO: 559) of the light chain sequence of SEQ ID NO: 541 or the variable light chain sequence of SEQ ID NO: 542.

In a preferred embodiment of the invention, polynucleotides of the invention comprise, or alternatively consist of, polynucleotides encoding Fab (fragment antigen binding) fragments having binding specificity for ACTH. With respect to antibody Ab12.H, the polynucleotides encoding the full length Ab12.H antibody comprise, or alternatively consist of, the polynucleotide SEQ ID NO: 531 encoding the heavy chain sequence of SEQ ID NO: 521 and the polynucleotide SEQ ID NO: 551 encoding the light chain sequence of SEQ ID NO: 541.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab12.H following expression of the full-length polynucleotides in a suitable host. In another embodiment of the invention, anti-ACTH antibodies such as Ab12.H or Fab fragments thereof may be produced via expression of Ab12.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab13.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 561:

(SEQ ID NO: 571)
gaggtgcagcttgtggagtctgggggaggcttggtccagcctggggggtc cctgagactctcctgtgcagcctctggattcaccgtcagtagcggctacg acatctgctgggtccgtcaggctccagggaaggggctggagtggatcgga tgcattgatactggtagtggtaacacttactacgctagctctgctaaagg ccgattcaccatgtccagagacaattccaagaacaccgtgtatcttcaaa tgaacagcctgagagctgaggacactgctgtgtattactgtgctaagggt atttctagtatatggggccaagggacctcgtcaccgtctcgagcgcctc caccaagggcccatcggtcttccccctggcaccctcctccaagagcacct ctggggcacagcggccctgggctgcctggtcaaggactacttccccgaa ccggtgacggtgtcgtggaactcaggcgccctgaccagcggcgtgcacac cttcccggctgtcctacagtcctcaggactctactccctcagcagcgtgg tgaccgtgccctccagcagcttgggcacccagacctacatctgcaacgtg aatcacaagcccagcaacaccaaggtggacaagaaagttgagcccaaatc ttgtgacaaaactcacacatgcccaccgtgcccagcacctgaactcctgg ggggaccgtcagtcttcctcttccccccaaaacccaaggacaccctcatg atctcccggacccctgaggtcacatgcgtggtggtggacgtgagccacga agacctgaggtcaagttcaactggtacgtggacggcgtggaggtgcata atgccaagacaaagccgcgggaggagcagtacgccagcacgtaccgtgtg gtcagcgtcctcaccgtcctgcaccaggactggctgaatggcaaggagta caagtgcaaggtctccaacaaagccctcccagccccatcgagaaaacca tctccaaagccaaagggcagccccgagaaccacaggtgtacaccctgccc ccatcccgggaggagatgaccaagaaccaggtcagcctgacctgcctggt caaaggcttctatcccagcgacatcgccgtggagtgggagagcaatgggc agccggagaacaactacaagaccacgcctcccgtgctggactccgacggc tccttcttcctctacagcaagctcaccgtggacaagagcaggtggcagca ggggaacgtcttctcatgctccgtgatgcatgaggctctgcacaaccact acacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 562:

In another embodiment of the invention, polynucleotides of the invention comprise, alternatively consist of, the following polynucleotide sequence encoding the constant heavy chain polypeptide sequence of SEQ ID NO: 570:

(SEQ ID NO: 572)
gaggtgcagcttgtggagtctgggggaggcttggtccagcctggggggtc cctgagactctcctgtgcagcctctggattcaccgtcagtagcggctacg acatctgctgggtccgtcaggctccagggaaggggctggagtggatcgga tgcattgatactggtagtggtaacacttactacgctagctctgctaaagg ccgattcaccatgtccagagacaattccaagaacaccgtgtatcttcaaa tgaacagcctgagagctgaggacactgctgtgtattactgtgctaagggt atttctagtatatggggccaagggaccctcgtcaccgtctcgagc.

In another embodiment of the invention, polynucleotides of the invention comprise, alternatively consist of, the following polynucleotide sequence encoding the constant heavy chain polypeptide sequence of SEQ ID NO: 570:

(SEQ ID NO: 580)
gcctccaccaagggcccatcggtcttccccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacaagaaagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 581:

(SEQ ID NO: 591)
gacatccagatgacccagtctccttccaccctgtctgcatctgtaggaga cagagtcaccatcacttgtcaggccagtcagaccattagtagcgacttag cctggtatcagcagaaaccaggaaaagcccctaagctcctgatctatgct gcatccaagctgacatctggagtcccatcaaggttcagcggcagtggatc tggaacagaattcactctcaccatcagcagcctgcagcctgatgattttg caacttactactgtcaaacatactatgatatcattgatgatggtgctact ttcggcggaggaaccaaggtggaaatcaaacgtacggtggctgcaccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.

In another embodiment of the invention, polynucleotides of the invention comprise, or alternatively consist of, the following polynucleotide sequence encoding the variable light chain polypeptide sequence of SEQ ID NO: 582:

(SEQ ID NO: 592)
gacatccagatgacccagtctccttccaccctgtctgcatctgtaggaga cagagtcaccatcacttgtcaggccagtcagaccattagtagcgacttag cctggtatcagcagaaaccaggaaaagcccctaagctcctgatctatgct gcatccaagctgacatctggagtcccatcaaggttcagcggcagtggatc tggaacagaattcactctcaccatcagcagcctgcagcctgatgattttg caacttactactgtcaaacatactatgatatcattgatgatggtgctact ttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 590:

(SEQ ID NO: 600)
acggtggctgcaccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 574; SEQ ID NO: 576; and SEQ ID NO: 578, which correspond to polynucleotides encoding the complementarity-determining regions (CDRs or hypervariable regions) of the heavy chain sequence of SEQ ID NO: 561 or the variable heavy chain sequence of SEQ ID NO: 562, and/or one or more of the polynucleotide sequences of SEQ ID NO: 594; SEQ ID NO: 596 and SEQ ID NO: 598, which correspond to the complementarity-determining regions (CDRs or hypervariable regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 573; SEQ ID NO: 575; SEQ ID NO: 577; and SEQ ID NO: 579, which correspond to polynucleotides encoding the framework regions (FRs or constant regions) of the heavy chain sequence of SEQ ID NO: 561 or the variable heavy chain sequence of SEQ ID NO: 562, and/or one or more of the polynucleotide sequences of SEQ ID NO: 593; SEQ ID NO: 595; SEQ ID NO: 597; and SEQ ID NO: 599, which correspond to the framework regions (FRs or constant regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 571 encoding the heavy chain sequence of SEQ ID NO: 561; the polynucleotide SEQ ID NO: 572 encoding the variable heavy chain sequence of SEQ ID NO: 562; the polynucleotide SEQ ID NO: 591 encoding the light chain sequence of SEQ ID NO: 581; the polynucleotide SEQ ID NO: 592 encoding the variable light chain sequence of SEQ ID NO: 582; polynucleotides encoding the complementarity-determining regions (SEQ ID NO: 574; SEQ ID NO: 576; and SEQ ID NO: 578) of the heavy chain sequence of SEQ ID NO: 561 or the variable heavy chain sequence of SEQ ID NO: 562; polynucleotides encoding the complementarity-determining regions (SEQ ID NO: 594; SEQ ID NO: 596; and SEQ ID NO: 598) of the light chain sequence of SEQ ID NO: 581 or the variable light chain sequence of SEQ ID NO: 582; polynucleotides encoding the framework regions (SEQ ID NO: 573; SEQ ID NO: 575; SEQ ID NO: 577; and SEQ ID NO: 579) of the heavy chain sequence of SEQ ID NO: 561 or the variable heavy chain sequence of SEQ ID NO: 562; and polynucleotides encoding the framework regions (SEQ ID NO: 593; SEQ ID NO: 595; SEQ ID NO: 597; and SEQ ID NO: 599) of the light chain sequence of SEQ ID NO: 581 or the variable light chain sequence of SEQ ID NO: 582.

In a preferred embodiment of the invention, polynucleotides of the invention comprise, or alternatively consist of, polynucleotides encoding Fab (fragment antigen binding) fragments having binding specificity for ACTH. With respect to antibody Ab13.H, the polynucleotides encoding the full length Ab13.H antibody comprise, or alternatively consist of, the polynucleotide SEQ ID NO: 571 encoding the heavy chain sequence of SEQ ID NO: 561 and the polynucleotide SEQ ID NO: 591 encoding the light chain sequence of SEQ ID NO: 581.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab13.H following expression of the full-length polynucleotides in a suitable host. In another embodiment of the invention, anti-ACTH antibodies such as Ab13.H or Fab fragments thereof may be produced via expression of Ab13.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab15.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 601:

```
                                           (SEQ ID NO: 611)
cagcagcagcttgtggagtctgggggaggcttggtccagcctgggggtc cctgagactctcctgtgcagcctctggattcaccgtcagtgacacctacg acatgtgctgggtccgtcaggctccagggaaggggctggagtggatcgga tgcatcgatactggtagtggtgacacttactacccaacctctgctaaagg ccgattcaccatctccagagacaattccaagaacaccctgtatcttcaaa tgaacagcctgagagctgaggacactgctgtgtattactgtgctaagggt gtttccagtttatggggccaagggaccctcgtcaccgtctcgagcgcctc caccaagggcccatcggtcttcccctggcaccctcctccaagagcacct ctgggggcacagcggccctgggctgcctggtcaaggactacttcccgaa ccggtgacggtgtcgtggaactcaggcgccctgaccagcggcgtgcacac cttcccggctgtcctacagtcctcaggactctactccctcagcagcgtgg tgaccgtgccctccagcagcttgggcacccagacctacatctgcaacgtg aatcacaagcccagcaacaccaaggtggacgcgagagttgagcccaaatc ttgtgacaaaactcacacatgcccaccgtgcccagcacctgaactcctgg ggggaccgtcagtcttcctcttccccccaaaacccaaggacaccctcatg atctcccggacccctgaggtcacatgcgtggtggtggacgtgagccacga agaccctgaggtcaagttcaactggtacgtggacggcgtggaggtgcata atgccaagacaaagccgcgggaggagcagtacgccagcacgtaccgtgtg gtcagcgtcctcaccgtcctgcaccaggactggctgaatggcaaggagta caagtgcaaggtctccaacaaagcctcccagccccatcgagaaaacca tctccaaagccaaagggcagccccgagaaccacaggtgtacaccctgccc ccatcccgggaggagatgaccaagaaccaggtcagcctgacctgcctggt caaaggcttctatcccagcgacatcgccgtggagtgggagagcaatgggc
```

-continued agccggagaacaactacaagaccacgcctcccgtgctggactccgacggc tccttcttcctctacagcaagctcaccgtggacaagagcaggtggcagca ggggaacgtcttctcatgctccgtgatgcatgaggctctgcacaaccact acacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 602:

(SEQ ID NO: 612)
cagcagcagcttgtggagtctgggggaggcttggtccagcctggggggtc cctgagactctcctgtgcagcctctggattcaccgtcagtgacacctacg acatgtgctgggtccgtcaggctccagggaaggggctggagtggatcgga tgcatcgatactggtagtggtgacacttactaccaacctctgctaaagg ccgattcaccatctccagagacaattccaagaacaccctgtatcttcaaa tgaacagcctgagagctgaggacactgctgtgtattactgtgctaagggt gtttccagtttatggggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 610:

(SEQ ID NO: 620)
gcctccaccaagggcccatcggtcttcccctggcacctcctccaagag cacctctggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagcctcccagcccccatcgagaa aaccatctccaaagccaaagggcagccccgagaaccacaggtgtacaccc tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 621:

(SEQ ID NO: 631)
gacatccagatgacccagtctccttccaccctgtctgcatctgtaggaga cagagtcaccatcacttgtcaggccagtgaggacattgaaagcgatttag cctggtatcagcagaaaccaggaaaagcccctaagctcctgatctatggt gcatccactctgaagtctggagtcccatcaaggttcagcggcagtggatc tggaacagaatacactctcaccatcagcagcctgcagcctgatgattttg caacttactactgtcaaacctattatgatatggctgatgatggtgctagt ttcggcggaggaaccaaggtggaaatcaaacgtacggtagcggccccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.

In another embodiment of the invention, polynucleotides of the invention comprise, or alternatively consist of, the following polynucleotide sequence encoding the variable light chain polypeptide sequence of SEQ ID NO: 622:

(SEQ ID NO: 632)
gacatccagatgacccagtctccttccaccctgtctgcatctgtaggaga cagagtcaccatcacttgtcaggccagtgaggacattgaaagcgatttag cctggtatcagcagaaaccaggaaaagcccctaagctcctgatctatggt gcatccactctgaagtctggagtcccatcaaggttcagcggcagtggatc tggaacagaatacactctcaccatcagcagcctgcagcctgatgattttg caacttactactgtcaaacctattatgatatggctgatgatggtgctagt ttcggcggaggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 630:

(SEQ ID NO: 640)
acggtagcggcccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcccctgacgctgagcaaagcagactacgagaaacacaaagtct acgcctgcgaagtcacccatcagggcctgagctcgcccgtcacaaagagc ttcaacaggggagagtgt.

In a further embodiment of the invention, polynucleotides encoding antibody fragments having binding specificity to ACTH comprise, or alternatively consist of, one or more of the polynucleotide sequences of SEQ ID NO: 614; SEQ ID NO: 616; and SEQ ID NO: 618, which correspond to polynucleotides encoding the complementarity-determining regions (CDRs or hypervariable regions) of the heavy chain sequence of SEQ ID NO: 601 or the variable heavy chain sequence of SEQ ID NO: 602, and/or one or more of the polynucleotide sequences of SEQ ID NO: 634; SEQ ID NO: 636 and SEQ ID NO: 638, which correspond to the complementarity-determining regions (CDRs or hypervariable regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 613; SEQ ID NO: 615; SEQ ID NO: 617; and SEQ ID NO: 619, which correspond to polynucleotides encoding the framework regions (FRs or constant regions) of the heavy chain sequence of SEQ ID NO: 601 or the variable heavy chain sequence of SEQ ID NO: 602, and/or one or more of the polynucleotide sequences of SEQ ID NO: 633; SEQ ID NO: 635; SEQ ID NO: 637; and SEQ ID NO: 639, which correspond to the framework regions (FRs or constant regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 611 encoding the heavy chain sequence of SEQ ID NO: 601; the polynucleotide SEQ ID NO: 612 encoding the variable heavy chain sequence of SEQ ID NO: 602; the polynucleotide SEQ ID NO: 631 encoding the light chain sequence of SEQ ID NO: 621; the polynucleotide SEQ ID NO: 632 encoding the variable light chain sequence of SEQ ID NO: 622; polynucleotides encoding the complementarity-determining regions (SEQ ID NO: 614; SEQ ID NO: 616; and SEQ ID NO: 618) of the heavy chain sequence of SEQ ID NO: 601 or the variable heavy chain sequence of SEQ ID NO: 602; polynucleotides encoding the complementarity-determining regions (SEQ ID NO: 634; SEQ ID NO: 636; and SEQ ID NO: 638) of the light chain sequence of SEQ ID NO: 621 or the variable light chain sequence of SEQ ID NO: 622; polynucleotides encoding the framework regions (SEQ ID NO: 613; SEQ ID NO: 615; SEQ ID NO: 617; and SEQ ID NO: 619) of the heavy chain sequence of SEQ ID NO: 601 or the variable heavy chain sequence of SEQ ID NO: 602; and polynucleotides encoding the framework regions (SEQ ID NO: 633; SEQ ID NO: 635; SEQ ID NO: 637; and SEQ ID NO: 639) of the light chain sequence of SEQ ID NO: 621 or the variable light chain sequence of SEQ ID NO: 622.

In a preferred embodiment of the invention, polynucleotides of the invention comprise, or alternatively consist of, polynucleotides encoding Fab (fragment antigen binding) fragments having binding specificity for ACTH. With respect to antibody Ab15.H, the polynucleotides encoding the full length Ab15.H antibody comprise, or alternatively consist of, the polynucleotide SEQ ID NO: 611 encoding the heavy chain sequence of SEQ ID NO: 601 and the polynucleotide SEQ ID NO: 631 encoding the light chain sequence of SEQ ID NO: 621.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab15.H following expression of the full-length polynucleotides in a suitable host. In another embodiment of the invention, anti-ACTH antibodies such as Ab15.H or Fab fragments thereof may be produced via expression of Ab15.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab17.H

In one embodiment, the invention is further directed to polynucleotides encoding antibody polypeptides having binding specificity to ACTH. In one embodiment of the invention, polynucleotides of the invention comprise, or alternatively consist of, the following polynucleotide sequence encoding the heavy chain sequence of SEQ ID NO: 641:

(SEQ ID NO: 651)
cagcagcagcttgtggagtctgggggaggcttggtccagcctgggggtc cctgagactctcctgtgcagcctctggattcaccgtcagtagcggctacg acatctgctgggtccgtcaggctccagggaaggggctggagtggatcgga tgcattgatactggtagtggtaacacttactacgccagctctgcaaaagg ccgattcaccatctccagagacaattccaagaacaccctgtatcttcaaa tgaacagcctgagagctgaggacactgctgtgtattactgtgctaagggt atttctagtttatggggccaagggaccctcgtcaccgtctcgagcgcctc caccaagggcccatcggtcttcccctggcaccctcctccaagagcacct ctgggggcacagcggccctgggctgcctggtcaaggactacttcccgaa ccggtgacggtgtcgtggaactcaggcgccctgaccagcggcgtgcacac cttcccggctgtcctacagtcctcaggactctactccctcagcagcgtgg tgaccgtgccctccagcagcttgggcacccagacctacatctgcaacgtg aatcacaagcccagcaacaccaaggtggacgcgagagttgagcccaaatc ttgtgacaaaactcacacatgcccaccgtgcccagcacctgaactcctgg ggggaccgtcagtcttcctcttcccccccaaaacccaaggacaccctcatg atctcccggacccctgaggtcacatgcgtggtggtggacgtgagccacga -continued agaccctgaggtcaagttcaactggtacgtggacggcgtggaggtgcata atgccaagacaaagccgcgggaggagcagtacgccagcacgtaccgtgtg gtcagcgtcctcaccgtcctgcaccaggactggctgaatggcaaggagta caagtgcaaggtctccaacaaagccctcccagcccccatcgagaaaacca tctccaaagccaaagggcagccccgagaaccacaggtgtacaccctgccc ccatcccgggaggagatgaccaagaaccaggtcagcctgacctgcctggt caaaggcttctatcccagcgacatcgccgtggagtgggagagcaatgggc agccggagaacaactacaagaccacgcctcccgtgctggactccgacggc tccttcttcctctacagcaagctcaccgtggacaagagcaggtggcagca ggggaacgtcttctcatgctccgtgatgcatgaggctctgcacaaccact acacgcagaagagcctctccctgtctccgggtaaa.

In another embodiment of the invention, the polynucleotides of the invention comprise, or alternatively consist of, the following polynucleotide sequence encoding the variable heavy chain polypeptide sequence of SEQ ID NO: 642:

(SEQ ID NO: 652)
cagcagcagcttgtggagtctgggggaggcttggtccagcctggggggtc cctgagactctcctgtgcagcctctggattcaccgtcagtagcggctacg acatctgctgggtccgtcaggctccagggaaggggctggagtggatcgga tgcattgatactggtagtggtaacacttactacgccagctctgcaaaagg ccgattcaccatctccagagacaattccaagaacaccctgtatcttcaaa tgaacagcctgagagctgaggacactgctgtgtattactgtgctaagggt atttctagtttatgggccaagggaccctcgtcaccgtctcgagc.

In another embodiment of the invention, polynucleotides of the invention comprise, or alternatively consist of, the following polynucleotide sequence encoding the constant heavy chain polypeptide sequence of SEQ ID NO: 650:

(SEQ ID NO: 660)
gcctccaccaagggcccatcggtcttccccctggcacctcctccaagag cacctctgggggcacagcggccctgggctgcctggtcaaggactacttcc ccgaaccggtgacggtgtcgtggaactcaggcgccctgaccagcggcgtg cacaccttcccggctgtcctacagtcctcaggactctactccctcagcag cgtggtgaccgtgccctccagcagcttgggcacccagacctacatctgca acgtgaatcacaagcccagcaacaccaaggtggacgcgagagttgagccc aaatcttgtgacaaaactcacacatgcccaccgtgcccagcacctgaact cctggggggaccgtcagtcttcctcttccccccaaaacccaaggacaccc tcatgatctcccggacccctgaggtcacatgcgtggtggtggacgtgagc cacgaagaccctgaggtcaagttcaactggtacgtggacggcgtggaggt gcataatgccaagacaaagccgcgggaggagcagtacgccagcacgtacc gtgtggtcagcgtcctcaccgtcctgcaccaggactggctgaatggcaag gagtacaagtgcaaggtctccaacaaagccctcccagcccccatcgagaa aaccatctccaaagccaaagggcagccccgagaaccacaggtgtacaccc -continued tgcccccatcccgggaggagatgaccaagaaccaggtcagcctgacctgc ctggtcaaaggcttctatcccagcgacatcgccgtggagtgggagagcaa tgggcagccggagaacaactacaagaccacgcctcccgtgctggactccg acggctccttcttcctctacagcaagctcaccgtggacaagagcaggtgg cagcaggggaacgtcttctcatgctccgtgatgcatgaggctctgcacaa ccactacacgcagaagagcctctccctgtctccgggtaaa.

In another embodiment of the invention, polynucleotides of the invention comprise, or alternatively consist of, the following polynucleotide sequence encoding the light chain polypeptide sequence of SEQ ID NO: 661:

(SEQ ID NO: 671)
gacatccagatgacccagtctccttccaccctgtctgcatctgtaggaga cagagtcaccatcacttgtcaggccagtcagaccattagtagcgacttag cctggtatcagcagaaaccaggaaaagcccctaagctcctgatctatgct gcatccaaactgacatctggagtcccatcaaggttcagcggcagtggatc tggaacagaattcactctcaccatcagcagcctgcagcctgatgattttg caacttactactgtcaaacctattatgatattagtgatgatggtgctact ttcggcggagggaaccaaggtggaaatcaaacgtacggtagcggccccatc tgtcttcatcttcccgccatctgatgagcagttgaaatctggaactgcct ctgttgtgtgcctgctgaataacttctatcccagagaggccaaagtacag tggaaggtggataacgccctccaatcgggtaactcccaggagagtgtcac agagcaggacagcaaggacagcacctacagcctcagcagcaccctgacgc tgagcaaagcagactacgagaaacacaaagtctacgcctgcgaagtcacc catcagggcctgagctcgcccgtcacaaagagcttcaacaggggagagtg t.

In another embodiment of the invention, polynucleotides of the invention comprise, or alternatively consist of, the following polynucleotide sequence encoding the variable light chain polypeptide sequence of SEQ ID NO: 662:

(SEQ ID NO: 672)
gacatccagatgacccagtctccttccaccctgtctgcatctgtaggaga cagagtcaccatcacttgtcaggccagtcagaccattagtagcgacttag cctggtatcagcagaaaccaggaaaagcccctaagctcctgatctatgct gcatccaaactgacatctggagtcccatcaaggttcagcggcagtggatc tggaacagaattcactctcaccatcagcagcctgcagcctgatgattttg caacttactactgtcaaacctattatgatattagtgatgatggtgctact ttcggcggagggaaccaaggtggaaatcaaacgt.

In another embodiment of the invention, polynucleotides of the invention comprise, or alternatively consist of, the following polynucleotide sequence encoding the constant light chain polypeptide sequence of SEQ ID NO: 670:

```
                                        (SEQ ID NO: 680)
acggtagcggccccatctgtcttcatcttcccgccatctgatgagcagtt gaaatctggaactgcctctgttgtgtgcctgctgaataacttctatccca gagaggccaaagtacagtggaaggtggataacgccctccaatcgggtaac tcccaggagagtgtcacagagcaggacagcaaggacagcacctacagcct cagcagcaccctgacgctgagcaaagcagactacgagaaacacaaagtct acgcctgcgaagtcacccatcagggcctgagctcgcccgtcacaaagagc ttcaacaggggagagtgt.
```

In a further embodiment of the invention, polynucleotides encoding antibody fragments having binding specificity to ACTH comprise, or alternatively consist of, one or more of the polynucleotide sequences of SEQ ID NO: 654; SEQ ID NO: 656; and SEQ ID NO: 658, which correspond to polynucleotides encoding the complementarity-determining regions (CDRs or hypervariable regions) of the heavy chain sequence of SEQ ID NO: 641 or the variable heavy chain sequence of SEQ ID NO: 642, and/or one or more of the polynucleotide sequences of SEQ ID NO: 674; SEQ ID NO: 676 and SEQ ID NO: 678, which correspond to the complementarity-determining regions (CDRs or hypervariable regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to ACTH comprise, or alternatively consist of, one or more of the polynucleotide sequences of SEQ ID NO: 653; SEQ ID NO: 655; SEQ ID NO: 657; and SEQ ID NO: 659, which correspond to polynucleotides encoding the framework regions (FRs or constant regions) of the heavy chain sequence of SEQ ID NO: 641 or the variable heavy chain sequence of SEQ ID NO: 642, and/or one or more of the polynucleotide sequences of SEQ ID NO: 673; SEQ ID NO: 675; SEQ ID NO: 677; and SEQ ID NO: 679, which correspond to the framework regions (FRs or constant regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to ACTH comprise, or alternatively consist of, one, two, three or more, including all of the following polynucleotides encoding antibody fragments: the polynucleotide SEQ ID NO: 651 encoding the heavy chain sequence of SEQ ID NO: 641; the polynucleotide SEQ ID NO: 652 encoding the variable heavy chain sequence of SEQ ID NO: 642; the polynucleotide SEQ ID NO: 671 encoding the light chain sequence of SEQ ID NO: 661; the polynucleotide SEQ ID NO: 672 encoding the variable light chain sequence of SEQ ID NO: 662; polynucleotides encoding the complementarity-determining regions (SEQ ID NO: 654; SEQ ID NO: 656; and SEQ ID NO: 658) of the heavy chain sequence of SEQ ID NO: 641 or the variable heavy chain sequence of SEQ ID NO: 642; polynucleotides encoding the complementarity-determining regions (SEQ ID NO: 674; SEQ ID NO: 676; and SEQ ID NO: 678) of the light chain sequence of SEQ ID NO: 661 or the variable light chain sequence of SEQ ID NO: 662; polynucleotides encoding the framework regions (SEQ ID NO: 653; SEQ ID NO: 655; SEQ ID NO: 657; and SEQ ID NO: 659) of the heavy chain sequence of SEQ ID NO: 641 or the variable heavy chain sequence of SEQ ID NO: 642; and polynucleotides encoding the framework regions (SEQ ID NO: 673; SEQ ID NO: 675; SEQ ID NO: 677; and SEQ ID NO: 679) of the light chain sequence of SEQ ID NO: 661 or the variable light chain sequence of SEQ ID NO: 662.

In a preferred embodiment of the invention, polynucleotides of the invention comprise, or alternatively consist of, polynucleotides encoding Fab (fragment antigen binding) fragments having binding specificity for ACTH. With respect to antibody Ab17.H, the polynucleotides encoding the full length Ab17.H antibody comprise, or alternatively consist of, the polynucleotide SEQ ID NO: 651 encoding the heavy chain sequence of SEQ ID NO: 641 and the polynucleotide SEQ ID NO: 671 encoding the light chain sequence of SEQ ID NO: 661.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab17.H following expression of the full-length polynucleotides in a suitable host. In another embodiment of the invention, anti-ACTH antibodies such as Ab17.H or Fab fragments thereof may be produced via expression of Ab17.H polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Host cells and vectors comprising said polynucleotides are also contemplated.

The invention further contemplates vectors comprising the polynucleotide sequences encoding the variable heavy and light chain polypeptide sequences, as well as the individual complementarity-determining regions (CDRs, or hypervariable regions), as set forth herein, as well as host cells comprising said vector sequences. In one embodiment of the invention, the host cell is a yeast cell. In another embodiment of the invention, the yeast host cell belongs to the genus *Pichia*.

Exemplary Embodiments of the Subject Disclosure

B-Cell Screening and Isolation

The subject anti-ACTH antibodies and variants thereof, especially chimerized variants were obtained from clonal populations of B cells derived from rabbits which had been immunized with human ACTH. Such B cell screening and isolation methods have been previously described and are disclosed in U.S. Provisional Application No. 61/791,755 filed Mar. 15, 2013, and U.S. Ser. No. 14/217,594 filed Mar. 18, 2014, which each of which is expressly incorporated by reference herein.

Methods of Humanizing Antibodies

In another embodiment, the present invention contemplates methods for humanizing antibody heavy and light chains. Methods for humanizing antibody heavy and light chains which may be applied to anti-ACTH antibodies are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties.

Methods of Producing Antibodies and Fragments Thereof

In another embodiment, the present invention contemplates methods for producing anti-ACTH antibodies and fragments thereof. Methods for producing anti-ACTH antibodies and fragments thereof secreted from polyploid, preferably diploid or tetraploid strains of mating competent yeast are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties. A preferred yeast for manufacture of antibodies is of the genus *Pichia*, and more preferably *Pichia pastoris*. However, antibodies according to the invention potentially may be made in other yeast such as other mating competent yeast of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis*; and *Zygosaccharomyces*. Other types of yeast potentially useful for making antibody proteins according to the invention include *Yarrowia; Rhodosporidium; Candida; Hansenula; Filobasium; Sporidiobolus; Bullera; Leucosporidium* and *Filobasidella*.

Other methods of producing antibodies are well known to those of ordinary skill in the art. For example, methods of producing chimeric antibodies are now well known in the art (See, for example, U.S. Pat. No. 4,816,567 to Cabilly et al.; Morrison et al., *PNAS. USA*, 81:8651-55 (1984); Neuberger, M. S. et al., *Nature*, 314:268-270 (1985); Boulianne, G. L. et al., *Nature*, 312:643-46 (1984), the disclosures of each of which are herein incorporated by reference in their entireties).

Likewise, other methods of producing humanized antibodies are now well known in the art (See, for example, U.S. Pat. Nos. 5,530,101, 5,585,089, 5,693,762, and 6,180,370 to Queen et al; U.S. Pat. Nos. 5,225,539 and 6,548,640 to Winter; U.S. Pat. Nos. 6,054,297, 6,407,213 and 6,639,055 to Carter et al; U.S. Pat. No. 6,632,927 to Adair; Jones, P. T. et al, *Nature*, 321:522-525 (1986); Reichmann, L., et al, *Nature*, 332:323-327 (1988); Verhoeyen, M, et al, *Science*, 239:1534-36 (1988), the disclosures of each of which are herein incorporated by reference in their entireties).

Antibody polypeptides of the invention having ACTH binding specificity may also be produced by constructing, using conventional techniques well known to those of ordinary skill in the art, an expression vector containing an operon and a DNA sequence encoding an antibody heavy chain in which the DNA sequence encoding the CDRs required for antibody specificity is derived from a non-human cell source, preferably a rabbit B-cell source, while the DNA sequence encoding the remaining parts of the antibody chain is derived from a human cell source.

A second expression vector is produced using the same conventional means well known to those of ordinary skill in the art, said expression vector containing an operon and a DNA sequence encoding an antibody light chain in which the DNA sequence encoding the CDRs required for antibody specificity is derived from a non-human cell source, preferably a rabbit B-cell source, while the DNA sequence encoding the remaining parts of the antibody chain is derived from a human cell source.

The expression vectors are transfected into a host cell by convention techniques well known to those of ordinary skill in the art to produce a transfected host cell, said transfected host cell cultured by conventional techniques well known to those of ordinary skill in the art to produce said antibody polypeptides.

The host cell may be co-transfected with the two expression vectors described above, the first expression vector containing DNA encoding an operon and a light chain-derived polypeptide and the second vector containing DNA encoding an operon and a heavy chain-derived polypeptide. The two vectors contain different selectable markers, but preferably achieve substantially equal expression of the heavy and light chain polypeptides. Alternatively, a single vector may be used, the vector including DNA encoding both the heavy and light chain polypeptides. The coding sequences for the heavy and light chains may comprise cDNA, genomic DNA, or both.

Host cells which potentially may be used to express the subject antibody polypeptides may include bacterial cells such as *E. coli*, or eukaryotic cells such as *P. pastoris*, other yeast cells, fungi, insect cells, mammalian cells, and plant cells. In one embodiment of the invention, a mammalian cell of a well-defined type may be for this purpose, such as a myeloma cell, a Chinese hamster ovary (CHO) cell line, a NSO cell line, or a HEK293 cell line.

The general methods by which the vectors may be constructed, transfection methods required to produce the host cell and culturing methods required to produce the antibody polypeptides from said host cells all include conventional techniques. Although preferably the cell line used to produce the antibody is a mammalian cell line, any other suitable cell line, such as a bacterial cell line such as an *E. coli*-derived bacterial strain, or a yeast cell line, may alternatively be used.

Similarly, once produced the antibody polypeptides may be purified according to standard procedures in the art, such as for example cross-flow filtration, ammonium sulphate precipitation, affinity column chromatography and the like.

The antibody polypeptides described herein may also be used for the design and synthesis of either peptide or non-peptide mimetics that would be useful for the same therapeutic applications as the antibody polypeptides of the invention. See, for example, Saragobi et al, *Science*, 253: 792-795 (1991), the contents of which are herein incorporated by reference in its entirety.

Screening Assays

The invention also includes screening assays designed to assist in the identification of diseases and disorders associated with ACTH in subjects exhibiting symptoms of an ACTH associated disease or disorder.

In some embodiments, the antibody is used as a diagnostic tool. The antibody can be used to assay the amount of ACTH present in a sample and/or subject. As will be appreciated by one of skill in the art, such antibodies need not be neutralizing antibodies. In some embodiments, the diagnostic antibody is not a neutralizing antibody. In some embodiments, the diagnostic antibody binds to a different epitope than the neutralizing antibody binds to. In some embodiments, the two antibodies do not compete with one another.

In some embodiments, the antibodies disclosed herein are used or provided in an assay kit and/or method for the detection of ACTH in mammalian tissues or cells in order to screen/diagnose for a disease or disorder associated with changes in levels of ACTH. The kit comprises an antibody that binds ACTH and means for indicating the binding of the antibody with ACTH, if present, and optionally ACTH protein levels. Various means for indicating the presence of an antibody can be used. For example, fluorophores, other molecular probes, or enzymes can be linked to the antibody and the presence of the antibody can be observed in a variety of ways. The method for screening for such disorders can involve the use of the kit, or simply the use of one of the disclosed antibodies and the determination of whether the antibody binds to ACTH in a sample. As will be appreciated by one of skill in the art, high or elevated levels of ACTH will result in larger amounts of the antibody binding to ACTH in the sample. Thus, degree of antibody binding can be used to determine how much ACTH is in a sample. Subjects or samples with an amount of ACTH that is greater than a predetermined amount (e.g., an amount or range that a person without an ACTH-related disorder would have) can be characterized as having an ACTH-mediated disorder. In some embodiments, the antibody is administered to a subject taking a statin, in order to determine if the statin has affected the amount of ACTH in the subject.

The invention is also directed to a method of in vivo imaging which detects the presence of cells which express ACTH comprising administering a diagnostically effective amount of a diagnostic composition. Said in vivo imaging is useful for the detection or imaging of ACTH expressing cells or organs, for example, and can be useful as part of a planning regimen for the design of an effective treatment protocol.

The present invention further provides for a kit for detecting binding of an anti-ACTH antibody of the invention to ACTH. In particular, the kit may be used to detect the presence of an ACTH specifically reactive with an anti-ACTH antibody of the invention or an immunoreactive fragment thereof. The kit may also include an antibody bound to a substrate, a secondary antibody reactive with the antigen and a reagent for detecting a reaction of the secondary antibody with the antigen. Such a kit may be an ELISA kit and can comprise the substrate, primary and secondary antibodies when appropriate, and any other necessary reagents such as detectable moieties, enzyme substrates, and color reagents, for example as described herein. The diagnostic kit may also be in the form of an immunoblot kit. The diagnostic kit may also be in the form of a chemiluminescent kit (Meso Scale Discovery, Gaithersburg, Md.). The diagnostic kit may also be a lanthanide-based detection kit (PerkinElmer, San Jose, Calif.).

A skilled clinician would understand that a biological sample includes, but is not limited to, sera, plasma, urine, saliva, mucous, pleural fluid, synovial fluid and spinal fluid.

Methods of Ameliorating or Reducing Symptoms of, or Treating, or Preventing, Diseases and Disorders Associated with, ACTH In another embodiment of the invention, anti-ACTH antibodies described herein, or fragments thereof, are useful for ameliorating or reducing the symptoms of, or treating, or preventing, diseases and disorders associated with ACTH. As mentioned, these conditions include, by way of example, ACTH-driven hypercortisolism, acute coronary syndrome, acute heart failure, anxiety disorders, atherosclerosis, atrial fibrillation, cachexia, cancer (such as Cushing's Syndrome resulting from ectopic ACTH expression, e.g., in small cell lung cancer, non-small cell lung cancer (NSCLC), pancreatic carcinoma, neural tumors, or thymoma), cardiac conditions, cardiac fibrosis, cardiovascular disorders, chronic renal failure, chronic stress syndrome, cognitive dysfunction, Alzheimer's disease, congenital adrenal hyperplasia (CAH), Classical CAH, Nonclassical CAH, familial glucocorticoid deficiency (FGD), congestive heart failure, Conn's syndrome, coronary heart diseases, Cushing's Disease, Cushing's Syndrome, depression, diabetes, endothelial dysfunction, exercise intolerance, familial hyperaldosteronism, fibrosis, galactorrhea, heart failure, hyperaldosteronism, hypercortisolemia, hypertension, hyperinsulinemia, hypokalemia, impaired cardiac function, increased formation of collagen, inflammation, metabolic syndrome, muscle atrophy, conditions associated with muscle atrophy, myocardiac fibrosis, nephropathy, obesity, post-myocardial infarction, primary hyperaldosteronism, remodeling following hypertension, renal failure, restenosis, secondary hyperaldosteronism, sleep apnea, stress related conditions, or syndrome X.

Anti-ACTH antibodies described herein, or fragments thereof, as well as combinations, can also be administered in a therapeutically or prophylactically effective amount to subjects in need of treatment or prevention of diseases and disorders associated with ACTH in the form of a pharmaceutical or diagnostic composition as described in greater detail below.

In another embodiment of the invention, anti-ACTH antibodies described herein, or fragments thereof, with or without a second agent, are useful for ameliorating or reducing the symptoms of, or treating, or preventing, disorders that relate to, involve, or can be influenced by varied ACTH, corticosterone, cortisol, and/or aldosterone levels. In some embodiments, the antibody or antibody fragment according to the invention is useful in reducing the risk of, symptoms of, treating, or preventing congenital adrenal hyperplasia (CAH), Classical CAH, Nonclassical CAH, familial glucocorticoid deficiency (FGD), ACTH-driven hypercortisolism (Cushing's Disease and/or Cushing's Syndrome), obesity, diabetes, sleep disorders such as, e.g., sleep apnea, narcolepsy and insomnia, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophy, hypertension, hyperinsulinemia, cognitive dysfunction, Alzheimer's disease, galactorrhea, stress related conditions, impaired cardiac function, exercise intolerance, heart failure and other cardiac conditions, metabolic syndrome, hyperaldosteronism including primary hyperaldosteronism (such as Conn's syndrome) secondary hyperaldosteronism, and familial hyperaldosteronism; or Allgrove syndrome, bilateral adrenalectomy, or Nelson's syndrome.

In further exemplary embodiments the present invention provides for monitoring and/or additional treatment of a subject (including a human or non-human animal subject) to which an anti-ACTH antibody of the present disclosure has been administered. Said monitoring may include monitoring of cortisol levels, and monitoring of other symptoms of adrenal insufficiency, such as primary and/or secondary adrenal insufficiency. Said additional treatment may include glucocorticoid and/or mineralocorticoid replacement, and/or treatment of other symptoms of adrenal insufficiency. Said glucocorticoid and/or mineralocorticoid replacement may be in an amount effective to treat adrenal insufficiency, or a symptom thereof. Without intent to be limited by theory, it is believed that in vivo antagonism of ACTH, such as that resulting from administration of an anti-ACTH antibody, may result in the development of one or more symptoms associated with adrenal insufficiency. Monitoring and treatment of adrenal insufficiency is reviewed in Arit and Allolio, "Adrenal Insufficiency," Lancet 361:1881-1893 (2003) and also described in The Merck Manual of Diagnosis and Therapy, 19th edition, Merck & Company, 19201192, each of which is hereby incorporated by reference in its entirety.

After administration of an anti-ACTH antibody, a subject may be monitored for symptoms associated with adrenal insufficiency, which may include symptoms associated with primary and/or secondary adrenal insufficiency. Such symptoms may include decreased cortisol levels and/or hypoglycemia after fasting (thought to result from decreased gluconeogenesis). Decreased cortisol levels may be detected as morning cortisol levels decreased to lower than a reference range (such as 165-680 nmol/L), e.g., to less than 165 nmol/L or less than 100 nmol/L. Said symptoms associated with primary and/or secondary adrenal insufficiency may include low serum sodium (e.g., <135 mEq/L), high serum potassium (e.g., >5 mEq/L), low carbonate (e.g., 15 to 20 mEq/L), and/or high BUN. Said symptoms may be compared to baseline measurements and observations prior to administration of an anti-ACTH antibody.

Glucocorticoid replacement therapy may include administration of hydrocortisone (such as at a dosage of between 15-25 mg daily, between 3-125 mg daily, or higher or lower dosages), cortisone acetate (such as at a dosage of 25-37.5 mg daily, between 5-200 mg daily, or higher or lower dosages), dexamethasone (such as at a dosage of 0.03 mg/kg/day to 0.15 mg/kg/day, between 0.005 mg/kg/day to 0.75 mg/kg/day, or higher or lower dosages), or other glucocorticoid administration. The glucocorticoid may be a glucocorticoid that does not interfere with monitoring of cortisol levels (such as dexamethasone). Preferably said glycocorticoid is administered in an amount effective to treat adrenal insufficiency, or a symptom thereof. Glucocorticoid replacement therapy may optionally be divided among multiple equal or unequal daily doses, e.g., half to two-third dose in the morning (such as immediately after rising) and the remainder in one or more subsequent doses. Glucocorticoid replacement therapy may be administered in a time-released form including but not limited to a single daily time-released administration. Glucocorticoid replacement therapy may also be delivered using an implantable medical device which may be adapted to release the drug in a controlled manner over an extended period of time, which may mimic the normal diurnal pattern of cortisol levels. Glucocorticoid replacement therapy may be adjusted as indicated by any signs or symptoms suggestive of over- or under-replacement. One such sign would be based on the ability of the subject to cope with daily stress (e.g., determined based on a fasting glucose test). Glucocorticoid dosage may be determined adjusted based on individual subject attributes, symptoms, and responses. Dosage may be increased in response to or anticipation of stress. For example, in advance of strenuous physical activity, a subject's dosage of hydrocortisone may be increased by approximately 5-10 mg per day. Further, for subjects under severe physical stress, such as fever, the hydrocortisone dosage may be increased, e.g., doubled. For major surgery, trauma, and diseases that require monitoring and intensive care, the hydrocortisone dosage may be increased to 100-150 mg per 24 hours. For more minor or moderate surgical stress lower dosages such as up to 25-75 mg hydrocortisone per 24 hours may be administered. Parenteral administration of glucocorticoids and/or mineralocorticoids may be performed in instances of vomiting or diarrhea.

Treatment of a subject may further include mineralocorticoid replacement, e.g., 0.05-0.2 mg fludrocortisone administered per day, such as in a single daily dose or other dosage form. Alternative or additional mineralocorticoids may be administered. Dosage may be determined adjusted based on individual subject attributes, symptoms, and responses. Further, effects of glucocorticoids and other treatments may be taken into consideration in selecting a dosage. For example, for hydrocortisone dosages of 50 mg per day (or higher), mineralocorticoid replacement may be reduced or omitted as such dosages of hydrocortisone can have similar effects as 0.1 mg fludrocortisone. Mineralocorticoid replacement may be initiated or altered based upon signs or symptoms indicative of a need therefore, or indicative of over- or under-replacement, e.g., as indicated by monitoring of blood pressure, peripheral edema, serum sodium, serum potassium, plasma renin activity, carbonate, and/or BUN.

Subjects may further be monitored and/or treated for adrenal crisis. Signs and symptoms of adrenal crisis include one or more of the following: sudden penetrating pain in the legs, lower back or abdomen; confusion; psychosis; slurred speech; severe lethargy; convulsions; fever; hyperkalemia; hypercalcemia; hypoglycemia; hyponatremia; hypotension; hypothyroid (low T4 level); severe vomiting and diarrhea, potentially resulting in dehydration; and/or syncope. In acute adrenal crisis, subjects may be immediately administered 100 mg hydrocortisone (typically intravenously) followed by 100-200 mg hydrocortisone per 24 hours. Adrenal crisis may also be treated by administration of 4-5 mg dexamethasone. A higher or lower dosage may be administered, e.g., immediate administration of between 20 and 250 mg hydrocortisone, or between 1 and 25 mg of dexamethasone, or a higher or lower dosage. Continuous large infusions of physiological saline may be performed, such as at a rate of 1 liter per hour or another amount effective to treat the patient. Continuous cardiac monitoring may be performed, with treatment optionally being modified appropriately as the subject's condition develops.

Administration

In one embodiment of the invention, the anti-ACTH antibodies described herein, or ACTH binding fragments thereof, as well as combinations of said antibodies or antibody fragments, are administered to a subject at a concentration of between about 0.1 and 100.0 mg/kg of body weight of recipient subject. In a preferred embodiment of the invention, the anti-ACTH antibodies described herein, or ACTH binding fragments thereof, as well as combinations of said antibodies or antibody fragments, are administered to a subject at a concentration of about 0.4 mg/kg of body weight of recipient subject. In a preferred embodiment of the invention, the anti-ACTH antibodies described herein, or ACTH binding fragments thereof, as well as combinations of said antibodies or antibody fragments, are administered to a recipient subject with a frequency of once every twenty-six weeks or less, such as once every sixteen weeks or less, once every eight weeks or less, once every four weeks or less, once every two weeks or less, once every week or less, or once daily or less.

Fab fragments may be administered every two weeks or less, every week or less, once daily or less, multiple times per day, and/or every few hours. In one embodiment of the invention, a subject receives Fab fragments of 0.1 mg/kg to 40 mg/kg per day given in divided doses of 1 to 6 times a day, or in a sustained release form, effective to obtain desired results.

It is to be understood that the concentration of the antibody or Fab administered to a given subject may be greater or lower than the exemplary administration concentrations set forth above.

A person of skill in the art would be able to determine an effective dosage and frequency of administration through routine experimentation, for example guided by the disclosure herein and the teachings in Goodman, L. S., Gilman, A., Brunton, L. L., Lazo, J. S., & Parker, K. L. (2006). Goodman & Gilman's the pharmacological basis of therapeutics. New York: McGraw-Hill; Howland, R. D., Mycek, M. J., Harvey, R. A., Champe, P. C., & Mycek, M. J. (2006). Pharmacology. Lippincott's illustrated reviews. Philadelphia: Lippincott Williams & Wilkins; and Golan, D. E. (2008). Principles of pharmacology: the pathophysiologic basis of drug therapy. Philadelphia, Pa., [etc.]: Lippincott Williams & Wilkins.

In another embodiment of the invention, the anti-ACTH antibodies described herein, or ACTH binding fragments thereof, as well as combinations of said antibodies or antibody fragments, are administered to a subject in a pharmaceutical formulation.

A "pharmaceutical composition" refers to a chemical or biological composition suitable for administration to a mammal. Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, transdermal, and transmucosal. In addition, administration can occur by means of injection, powder, liquid, gel, drops, or other means of administration.

In one embodiment of the invention, the anti-ACTH antibodies described herein, or ACTH binding fragments thereof, as well as combinations of said antibodies or antibody fragments, may be optionally administered in combination with one or more active agents. Such active agents include ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®). Additional exemplary active agents that may be administered in combination with the subject antibodies or fragments include without limitation thereto one or more of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), or Zestril (lisinopril). Further exemplary active agents include one or more corticosteroids, including glucocorticoids and/or mineralocorticoids (including agents having one or both of glucocorticoid and/or mineralocorticoid activity), such as cortisol (hydrocortisone), dexamethasone, cortisone, prednisone, prednisolone, methylprednisolone, dexamethasone, betamethasone, triamcinolone, beclometasone, fludrocortisone (e.g., fludrocortisone acetate), deoxycorticosterone (e.g., deoxycorticosterone acetate (DOCA)), and/or aldosterone. Any suitable combination of these active agents is also contemplated.

A "pharmaceutical excipient" or a "pharmaceutically acceptable excipient" is a carrier, usually a liquid, in which an active therapeutic agent is formulated. In one embodiment of the invention, the active therapeutic agent is a humanized antibody described herein, or one or more fragments thereof. The excipient generally does not provide any pharmacological activity to the formulation, though it may provide chemical and/or biological stability, and release characteristics. Exemplary formulations can be found, for example, in Remington's Pharmaceutical Sciences, 19$^{th}$ Ed., Grennaro, A., Ed., 1995 which is incorporated by reference.

As used herein "pharmaceutically acceptable carrier" or "excipient" includes any and all solvents, dispersion media, coatings, antibacterial and antifungal agents, isotonic and absorption delaying agents that are physiologically compatible. In one embodiment, the carrier is suitable for parenteral administration. Alternatively, the carrier can be suitable for intravenous, intraperitoneal, or intramuscular administration. Pharmaceutically acceptable carriers include sterile aqueous solutions or dispersions and sterile powders for the extemporaneous preparation of sterile injectable solutions or dispersions. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions.

Pharmaceutical compositions typically must be sterile and stable under the conditions of manufacture and storage. The invention contemplates that the pharmaceutical composition is present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The invention further contemplates the inclusion of a stabilizer in the pharmaceutical composition. The proper fluidity can be maintained, for example, by the maintenance of the required particle size in the case of dispersion and by the use of surfactants.

In many cases, it will be preferable to include isotonic agents, for example, sugars, polyalcohols such as mannitol or sorbitol, or sodium chloride in the composition. Prolonged absorption of the injectable compositions can be brought about by including in the composition an agent which delays absorption, for example, monostearate salts and gelatin. Moreover, the alkaline polypeptide can be formulated in a time-release formulation, for example in a composition which includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are known to those skilled in the art.

For each of the recited embodiments, the compounds can be administered by a variety of dosage forms. Any biologically-acceptable dosage form known to persons of ordinary skill in the art, and combinations thereof, are contemplated. Examples of such dosage forms include, without limitation, reconstitutable powders, elixirs, liquids, solutions, suspensions, emulsions, powders, granules, particles, microparticles, dispersible granules, cachets, inhalants, aerosol inhalants, patches, particle inhalants, implants, depot implants, injectables (including subcutaneous, intramuscular, intravenous, and intradermal), infusions, and combinations thereof.

Certain teachings related to humanization of rabbit-derived monoclonal antibodies and preferred sequence modifications to maintain antigen binding affinity were disclosed in International Application No. PCT/US2008/064421, corresponding to International Publication No. WO/2008/144757, entitled "Novel Rabbit Antibody Humanization Methods and Humanized Rabbit Antibodies", filed May 21, 2008, the disclosure of which is herein incorporated by reference in its entirety.

Certain teachings related to producing antibodies or fragments thereof using mating competent yeast and corresponding methods were disclosed in U.S. patent application Ser. No. 11/429,053, filed May 8, 2006, (U.S. Patent Application Publication No. US2006/0270045), the disclosure of which is herein incorporated by reference in its entirety.

Veterinary Uses of the Subject Antibodies

The present disclosure additionally provides the use of the subject antibodies in non-human animals. The working examples herein demonstrate that the subject antibodies bind within a region of human ACTH that is conserved among animal species including dog, cat, and horse. A fragment of ACTH containing this conserved epitope sequence (ACTH 1-24) can activate ACTH receptors, and the subject antibodies are demonstrated herein to inhibit receptor activation by this fragment. Based on these and other results presented herein, it is expected that the antibodies of the invention will be therapeutically effective for antagonizing ACTH in vivo in these and other animal species. Thus, antibodies or antibody fragments comprising one or more, or all, of the CDRs of any one of the antibodies disclosed herein (e.g., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H) may be effective to treat a condition associated with ACTH in a non-human animal.

In exemplary embodiments, the disclosure provides a therapeutic method comprising administering an antibody or antibody fragment comprising one or more, or all, of the CDRs of any one of the anti-ACTH antibodies disclosed herein (e.g., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H) to a non-human animal in need thereof.

In exemplary embodiments, the disclosure provides a therapeutic composition comprising an antibody or antibody fragment comprising one or more, or all, of the CDRs of any one of the anti-ACTH antibodies disclosed herein (e.g., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H) which is adapted for administration to a non-human animal in need thereof.

In exemplary embodiments, the disclosure provides a comprising an antibody or antibody fragment comprising one or more, or all, of the CDRs of any one of the anti-ACTH antibodies disclosed herein (e.g., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H) for use in the treatment of a non-human animal in need thereof.

Said antibody or fragment may be modified to reduce the potential immune reaction of said animal. For example, said antibody may be a chimeric antibody comprising the variable light and/or variable heavy domain of any one of the anti-ACTH antibodies disclosed herein (e.g., Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H, preferably Ab13.H) in combination with a constant domain sequence of the respective animal species (such as dog, cat, or horse). Said antibody or fragment may comprise an antibody fragment, such as scFvs, Fab fragments, Fab' fragments, monovalent antibody fragments, and F(ab')$_2$ fragments. Said antibody or fragment may comprise a species-ized antibody (e.g., caninized, felinized, or equinized antibody for cats, dogs, or horses, respectively) produced by a process analogous to humanization, wherein one or more framework sequences or framework residues are replaced by framework sequences or residues contained within endogenous framework sequences of antibodies of the respective species.

Said animal species may be a species in which endogenous ACTH is conserved, e.g., having the same sequence as human ACTH, or having up to one, two, three, four, or five sequence differences from human ACTH or from human ACTH 1-24. For example, the ACTH of said species may have one or more, or all, of the epitope binding residues identified in the examples herein that are the same as the residues in human ACTH, or having conservative substitutions relative to the corresponding residues in human ACTH. Preferably the administered anti-ACTH antibody is able to bind to ACTH of said animal species and antagonize activation of an ACTH receptor in said animal species.

Additional Exemplary Embodiments of the Invention

Additional exemplary embodiments of the invention are set forth in the following clauses.

Clause 1A. A human, humanized or chimerized anti-human ACTH antibody or antibody fragment that specifically binds to a linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 2A. A human, humanized or chimerized anti-human ACTH antibody or antibody fragment of Clause 1A, which specifically binds to the same linear or conformational epitope(s) and/or competes for binding to the same linear or conformational epitope(s) on human ACTH as Ab13.H.

Clause 3A. A human, humanized or chimerized anti-human ACTH antibody or antibody fragment of Clause 1A, which specifically binds to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 4A. A human, humanized or chimerized anti-human ACTH antibody or antibody fragment of Clause 1A, which specifically binds to the same linear or conformational epitope(s) on human ACTH as Ab13.H.

Clause 5A. A human, humanized or chimerized anti-human ACTH antibody or antibody fragment of Clause 1A, wherein said epitope(s) is identified using a binding assay that detects the binding of said anti-human ACTH antibody or antibody fragment to one or more peptides in a library of overlapping linear peptide fragments that span the full length of human ACTH.

Clause 6A. A human, humanized or chimerized anti-human ACTH antibody or antibody fragment of Clause 1A, wherein said epitope is identified using alanine scanning.

Clause 7A. A human, humanized or chimerized anti-human ACTH antibody or antibody fragment that contains at least 2 complementarity determining regions (CDRs) of an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 8A. A human, humanized or chimerized anti-human ACTH antibody or antibody fragment according to Clause 7A, which contains at least 3 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 9A. A human, humanized or chimerized anti-human ACTH antibody or antibody fragment according to Clause 7A, which contains at least 4 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 10A. A human, humanized or chimerized anti-human ACTH antibody or antibody fragment according to Clause 7A, which contains at least 5 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 11A. A human, humanized or chimerized anti-human ACTH antibody or antibody fragment according to Clause 7A, which contains all 6 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 12A. A human, humanized or chimerized anti-human ACTH antibody or antibody fragment according to any one of Clauses 1A-11A, which comprises:

(a) a variable heavy chain comprising a CDR1 sequence consisting of SEQ ID NO:4; a CDR2 sequence consisting of SEQ ID NO:6; and a CDR3 sequence consisting of SEQ ID NO:8; and/or (b) a variable light chain comprising a CDR1 sequence consisting of SEQ ID NO:24; a CDR2 sequence consisting of SEQ ID NO:26; and a CDR3 sequence consisting of SEQ ID NO:28.

Clause 13A. A anti-human ACTH antibody or antibody fragment according to Clause 12A, which comprises:

(a) a variable heavy chain comprising an amino acid sequence with at least 80, 85, 90, 95, 96, 97, 98, or 99% sequence identity to SEQ ID NO:2 and/or (b) a variable light chain comprising an amino acid sequence with at least 80, 85, 90, 95, 96, 97, 98, or 99% sequence identity to SEQ ID NO:22.

Clause 14A. An anti-human ACTH antibody or antibody fragment according to Clause 12A, which comprises:

(a) a variable heavy chain having the amino acid sequence of SEQ ID NO:2, and/or (b) a variable light chain having the amino acid sequence of SEQ ID NO:22.

Clause 15A. An anti-human ACTH antibody or antibody fragment according to Clause 12A, which comprises:

(a) a heavy chain having the amino acid sequence of SEQ ID NO: 1, and/or (b) a light chain having the amino acid sequence of SEQ ID NO:21.

Clause 16A. An human, humanized or chimerized anti-human ACTH antibody or antibody fragment according to any one of Clauses 1A-11A, which comprises:

(a) a variable heavy chain comprising a CDR1 sequence consisting of SEQ ID NO:44; a CDR2 sequence consisting of SEQ ID NO:46; and a CDR3 sequence consisting of SEQ ID NO:48; and/or (b) a variable light chain comprising a CDR1 sequence consisting of SEQ ID NO:64; a CDR2 sequence consisting of SEQ ID NO:66; and a CDR3 sequence consisting of SEQ ID NO:68.

217

Clause 17A. An anti-human ACTH antibody or antibody fragment according to Clause 16A, which comprises:
(a) a variable heavy chain comprising an amino acid sequence with at least 80, 85, 90, 95, 96, 97, 98, or 99% sequence identity to SEQ ID NO:42, and/or
(b) a variable light chain comprising an amino acid sequence with at least 80, 85, 90, 95, 96, 97, 98, or 99% sequence identity to SEQ ID NO:62.

Clause 18A. An anti-human ACTH antibody or antibody fragment according to Clause 16A, which comprises:
(a) a variable heavy chain having the amino acid sequence of SEQ ID NO:42, and/or
(b) a variable light chain having the amino acid sequence of SEQ ID NO:62.

Clause 19A. An anti-human ACTH antibody or antibody fragment according to Clause 16A, which comprises:
(a) a heavy chain having the amino acid sequence of SEQ ID NO:41, and/or
(b) a light chain having the amino acid sequence of SEQ ID NO:61.

Clause 20A. An human, humanized or chimerized anti-human ACTH antibody or antibody fragment according to any one of Clauses 1A-11A, which comprises:
(a) a variable heavy chain comprising a CDR1 sequence consisting of SEQ ID NO:84; a CDR2 sequence consisting of SEQ ID NO:86; and a CDR3 sequence consisting of SEQ ID NO:88; and/or
(b) a variable light chain comprising a CDR1 sequence consisting of SEQ ID NO: 104; a CDR2 sequence consisting of SEQ ID NO: 106; and a CDR3 sequence consisting of SEQ ID NO: 108.

Clause 21A. An anti-human ACTH antibody or antibody fragment according to Clause 20A, which comprises:
(a) a variable heavy chain comprising an amino acid sequence with at least 80, 85, 90, 95, 96, 97, 98, or 99% sequence identity to SEQ ID NO:82 and/or
(b) a variable light chain comprising an amino acid sequence with at least 80, 85, 90, 95, 96, 97, 98, or 99% sequence identity to SEQ ID NO: 102.

Clause 22A. An anti-human ACTH antibody or antibody fragment according to Clause 20A, which comprises:
(a) a variable heavy chain having the amino acid sequence of SEQ ID NO:82, and/or
(b) a variable light chain having the amino acid sequence of SEQ ID NO: 102.

Clause 23A. An anti-human ACTH antibody or antibody fragment according to Clause 20A, which comprises:
(a) a heavy chain having the amino acid sequence of SEQ ID NO:81, and/or
(b) a light chain having the amino acid sequence of SEQ ID NO: 101.

Clause 24A. An human, humanized or chimerized anti-human ACTH antibody or antibody fragment according to any one of Clauses 1A-11A, which comprises:
(a) a variable heavy chain comprising a CDR1 sequence consisting of SEQ ID NO: 124; a CDR2 sequence consisting of SEQ ID NO: 126; and a CDR3 sequence consisting of SEQ ID NO: 128; and/or
(b) a variable light chain comprising a CDR1 sequence consisting of SEQ ID NO: 144; a CDR2 sequence consisting of SEQ ID NO: 146; and a CDR3 sequence consisting of SEQ ID NO: 148.

Clause 25A. An anti-human ACTH antibody or antibody fragment according to Clause 24A, which comprises:
(a) a variable heavy chain comprising an amino acid sequence with at least 80, 85, 90, 95, 96, 97, 98, or 99% sequence identity to SEQ ID NO: 122 and/or

218

(b) a variable light chain comprising an amino acid sequence with at least 80, 85, 90, 95, 96, 97, 98, or 99% sequence identity to SEQ ID NO: 142.

Clause 26A. An anti-human ACTH antibody or antibody fragment according to Clause 24A, which comprises:
(a) a variable heavy chain having the amino acid sequence of SEQ ID NO: 122, and/or
(b) a variable light chain having the amino acid sequence of SEQ ID NO: 142.

Clause 27A. An anti-human ACTH antibody or antibody fragment according to Clause 24A, which comprises:
(a) a heavy chain having the amino acid sequence of SEQ ID NO: 121, and/or
(b) a light chain having the amino acid sequence of SEQ ID NO: 141.

Clause 28A. An human, humanized or chimerized anti-human ACTH antibody or antibody fragment according to any one of Clauses 1A-11A, which comprises:
(a) a variable heavy chain comprising a CDR1 sequence consisting of SEQ ID NO: 164; a CDR2 sequence consisting of SEQ ID NO: 166; and a CDR3 sequence consisting of SEQ ID NO: 168; and/or
(b) a variable light chain comprising a CDR1 sequence consisting of SEQ ID NO:184; a CDR2 sequence consisting of SEQ ID NO: 186; and a CDR3 sequence consisting of SEQ ID NO: 188.

Clause 29A. An anti-human ACTH antibody or antibody fragment according to Clause 28A, which comprises:
(a) a variable heavy chain comprising an amino acid sequence with at least 80, 85, 90, 95, 96, 97, 98, or 99% sequence identity to SEQ ID NO: 162, and/or
(b) a variable light chain comprising an amino acid sequence with at least 80, 85, 90, 95, 96, 97, 98, or 99% sequence identity to SEQ ID NO: 182.

Clause 30A. An anti-human ACTH antibody or antibody fragment according to Clause 28A, which comprises:
(a) a variable heavy chain having the amino acid sequence of SEQ ID NO: 162, and/or
(b) a variable light chain having the amino acid sequence of SEQ ID NO: 182.

Clause 31A. An anti-human ACTH antibody or antibody fragment according to Clause 28A, which comprises:
(a) a heavy chain having the amino acid sequence of SEQ ID NO: 161, and/or
(b) a light chain having the amino acid sequence of SEQ ID NO: 181.

Clause 32A. An human, humanized or chimerized anti-human ACTH antibody or antibody fragment according to any one of Clauses 1A-11A, which comprises:
(a) a variable heavy chain comprising a CDR1 sequence consisting of SEQ ID NO:204; a CDR2 sequence consisting of SEQ ID NO:206; and a CDR3 sequence consisting of SEQ ID NO:208; and/or
(b) a variable light chain comprising a CDR1 sequence consisting of SEQ ID NO:224; a CDR2 sequence consisting of SEQ ID NO:226; and a CDR3 sequence consisting of SEQ ID NO:228.

Clause 33A. An anti-human ACTH antibody or antibody fragment according to Clause 32A, which comprises:
(a) a variable heavy chain comprising an amino acid sequence with at least 80, 85, 90, 95, 96, 97, 98, or 99% sequence identity to SEQ ID NO:202 and/or
(b) a variable light chain comprising an amino acid sequence with at least 80, 85, 90, 95, 96, 97, 98, or 99% sequence identity to SEQ ID NO:222.

Clause 34A. An anti-human ACTH antibody or antibody fragment according to Clause 32A, which comprises:

(a) a variable heavy chain having the amino acid sequence of SEQ ID NO:202, and/or (b) a variable light chain having the amino acid sequence of SEQ ID NO:223.

Clause 35A. An anti-human ACTH antibody or antibody fragment according to Clause 32A, which comprises:

(a) a heavy chain having the amino acid sequence of SEQ ID NO:201, and/or (b) a light chain having the amino acid sequence of SEQ ID NO:221.

Clause 36A. An human, humanized or chimerized anti-human ACTH antibody or antibody fragment according to any one of Clauses 1A-11A, which comprises:

(a) a variable heavy chain comprising a CDR1 sequence consisting of SEQ ID NO:244; a CDR2 sequence consisting of SEQ ID NO:246; and a CDR3 sequence consisting of SEQ ID NO:248; and/or (b) a variable light chain comprising a CDR1 sequence consisting of SEQ ID NO:264; a CDR2 sequence consisting of SEQ ID NO:266; and a CDR3 sequence consisting of SEQ ID NO:268.

Clause 37A. An anti-human ACTH antibody or antibody fragment according to Clause 36A, which comprises:

(a) a variable heavy chain comprising an amino acid sequence with at least 80, 85, 90, 95, 96, 97, 98, or 99% sequence identity to SEQ ID NO:242 and/or (b) a variable light chain comprising an amino acid sequence with at least 80, 85, 90, 95, 96, 97, 98, or 99% sequence identity to SEQ ID NO:262.

Clause 38A. An anti-human ACTH antibody or antibody fragment according to Clause 36A, which comprises:

(a) a variable heavy chain having the amino acid sequence of SEQ ID NO:242, and/or (b) a variable light chain having the amino acid sequence of SEQ ID NO:262.

Clause 39A. An anti-human ACTH antibody or antibody fragment according to Clause 36A, which comprises:

(a) a heavy chain having the amino acid sequence of SEQ ID NO:241, and/or (b) a light chain having the amino acid sequence of SEQ ID NO:261.

Clause 40A. An human, humanized or chimerized anti-human ACTH antibody or antibody fragment according to any one of Clauses 1A-11A, which comprises:

(a) a variable heavy chain comprising a CDR1 sequence consisting of SEQ ID NO:284; a CDR2 sequence consisting of SEQ ID NO:286; and a CDR3 sequence consisting of SEQ ID NO:288; and/or (b) a variable light chain comprising a CDR1 sequence consisting of SEQ ID NO:304; a CDR2 sequence consisting of SEQ ID NO:306; and a CDR3 sequence consisting of SEQ ID NO:308.

Clause 41A. An anti-human ACTH antibody or antibody fragment according to Clause 40A, which comprises:

(a) a variable heavy chain comprising an amino acid sequence with at least 80, 85, 90, 95, 96, 97, 98, or 99% sequence identity to SEQ ID NO:282, and/or (b) a variable light chain comprising an amino acid sequence with at least 80, 85, 90, 95, 96, 97, 98, or 99% sequence identity to SEQ ID NO:302.

Clause 42A. An anti-human ACTH antibody or antibody fragment according to Clause 40A, which comprises:

(a) a variable heavy chain having the amino acid sequence of SEQ ID NO:282, and/or (b) a variable light chain having the amino acid sequence of SEQ ID NO:302.

Clause 43A. An anti-human ACTH antibody or antibody fragment according to Clause 40A, which comprises:

(a) a heavy chain having the amino acid sequence of SEQ ID NO:281, and/or (b) a light chain having the amino acid sequence of SEQ ID NO:301.

Clause 40.1A. An human, humanized or chimerized anti-human ACTH antibody or antibody fragment according to any one of Clauses 1A-11A, which comprises:

(a) a variable heavy chain comprising a CDR1 sequence consisting of SEQ ID NO:324; a CDR2 sequence consisting of SEQ ID NO:326; and a CDR3 sequence consisting of SEQ ID NO:328; and/or (b) a variable light chain comprising a CDR1 sequence consisting of SEQ ID NO:344; a CDR2 sequence consisting of SEQ ID NO:346; and a CDR3 sequence consisting of SEQ ID NO:348.

Clause 41.1A. An anti-human ACTH antibody or antibody fragment according to Clause 40.1A, which comprises:

(a) a variable heavy chain comprising an amino acid sequence with at least 80, 85, 90, 95, 96, 97, 98, or 99% sequence identity to SEQ ID NO:322, and/or (b) a variable light chain comprising an amino acid sequence with at least 80, 85, 90, 95, 96, 97, 98, or 99% sequence identity to SEQ ID NO:342.

Clause 42.1A. An anti-human ACTH antibody or antibody fragment according to Clause 40.1A, which comprises:

(a) a variable heavy chain having the amino acid sequence of SEQ ID NO:322, and/or (b) a variable light chain having the amino acid sequence of SEQ ID NO:342.

Clause 43.1A. An anti-human ACTH antibody or antibody fragment according to Clause 40.1A, which comprises:

(a) a heavy chain having the amino acid sequence of SEQ ID NO:321, and/or (b) a light chain having the amino acid sequence of SEQ ID NO:341.

Clause 40.2A. An human, humanized or chimerized anti-human ACTH antibody or antibody fragment according to any one of Clauses 1A-11A, which comprises:

(a) a variable heavy chain comprising a CDR1 sequence consisting of SEQ ID NO:364; a CDR2 sequence consisting of SEQ ID NO:366; and a CDR3 sequence consisting of SEQ ID NO:368; and/or (b) a variable light chain comprising a CDR1 sequence consisting of SEQ ID NO:384; a CDR2 sequence consisting of SEQ ID NO:386; and a CDR3 sequence consisting of SEQ ID NO:388.

Clause 41.2A. An anti-human ACTH antibody or antibody fragment according to Clause 40.2A, which comprises:

(a) a variable heavy chain comprising an amino acid sequence with at least 80, 85, 90, 95, 96, 97, 98, or 99% sequence identity to SEQ ID NO:362, and/or (b) a variable light chain comprising an amino acid sequence with at least 80, 85, 90, 95, 96, 97, 98, or 99% sequence identity to SEQ ID NO:382.

Clause 42.2A. An anti-human ACTH antibody or antibody fragment according to Clause 40.2A, which comprises:

(a) a variable heavy chain having the amino acid sequence of SEQ ID NO:362, and/or (b) a variable light chain having the amino acid sequence of SEQ ID NO:382.

Clause 43.2A. An anti-human ACTH antibody or antibody fragment according to Clause 40.2A, which comprises:

(a) a heavy chain having the amino acid sequence of SEQ ID NO:361, and/or (b) a light chain having the amino acid sequence of SEQ ID NO:381.

Clause 40.3A. An human, humanized or chimerized anti-human ACTH antibody or antibody fragment according to any one of Clauses 1A-11A, which comprises:
(a) a variable heavy chain comprising a CDR1 sequence consisting of SEQ ID NO:404; a CDR2 sequence consisting of SEQ ID NO:406; and a CDR3 sequence consisting of SEQ ID NO:408; and/or
(b) a variable light chain comprising a CDR1 sequence consisting of SEQ ID NO:424; a CDR2 sequence consisting of SEQ ID NO:426; and a CDR3 sequence consisting of SEQ ID NO:428.

Clause 41.3A. An anti-human ACTH antibody or antibody fragment according to Clause 40.3A, which comprises:
(a) a variable heavy chain comprising an amino acid sequence with at least 80, 85, 90, 95, 96, 97, 98, or 99% sequence identity to SEQ ID NO:402, and/or
(b) a variable light chain comprising an amino acid sequence with at least 80, 85, 90, 95, 96, 97, 98, or 99% sequence identity to SEQ ID NO:422.

Clause 42.3A. An anti-human ACTH antibody or antibody fragment according to Clause 40.3A, which comprises:
(a) a variable heavy chain having the amino acid sequence of SEQ ID NO:402, and/or
(b) a variable light chain having the amino acid sequence of SEQ ID NO:422.

Clause 43.3A. An anti-human ACTH antibody or antibody fragment according to Clause 40.3A, which comprises:
(a) a heavy chain having the amino acid sequence of SEQ ID NO:401, and/or
(b) a light chain having the amino acid sequence of SEQ ID NO:421.

Clause 40.4A. An human, humanized or chimerized anti-human ACTH antibody or antibody fragment according to any one of Clauses 1A-11A, which comprises:
(a) a variable heavy chain comprising a CDR1 sequence consisting of SEQ ID NO:444; a CDR2 sequence consisting of SEQ ID NO:446; and a CDR3 sequence consisting of SEQ ID NO:448; and/or
(b) a variable light chain comprising a CDR1 sequence consisting of SEQ ID NO:464; a CDR2 sequence consisting of SEQ ID NO:466; and a CDR3 sequence consisting of SEQ ID NO:468.

Clause 41.4A. An anti-human ACTH antibody or antibody fragment according to Clause 40.4A, which comprises:
(a) a variable heavy chain comprising an amino acid sequence with at least 80, 85, 90, 95, 96, 97, 98, or 99% sequence identity to SEQ ID NO:442, and/or
(b) a variable light chain comprising an amino acid sequence with at least 80, 85, 90, 95, 96, 97, 98, or 99% sequence identity to SEQ ID NO:462.

Clause 42.4A. An anti-human ACTH antibody or antibody fragment according to Clause 40.4A, which comprises:
(a) a variable heavy chain having the amino acid sequence of SEQ ID NO:442, and/or
(b) a variable light chain having the amino acid sequence of SEQ ID NO:462.

Clause 43.4A. An anti-human ACTH antibody or antibody fragment according to Clause 40.4A, which comprises:
(a) a heavy chain having the amino acid sequence of SEQ ID NO:441, and/or
(b) a light chain having the amino acid sequence of SEQ ID NO:461.

Clause 40.5A. An human, humanized or chimerized anti-human ACTH antibody or antibody fragment according to any one of Clauses 1A-11A, which comprises:
(a) a variable heavy chain comprising a CDR1 sequence consisting of SEQ ID NO:484; a CDR2 sequence consisting of SEQ ID NO:486; and a CDR3 sequence consisting of SEQ ID NO:488; and/or
(b) a variable light chain comprising a CDR1 sequence consisting of SEQ ID NO:504; a CDR2 sequence consisting of SEQ ID NO:506; and a CDR3 sequence consisting of SEQ ID NO:508.

Clause 41.5A. An anti-human ACTH antibody or antibody fragment according to Clause 40.5A, which comprises:
(a) a variable heavy chain comprising an amino acid sequence with at least 80, 85, 90, 95, 96, 97, 98, or 99% sequence identity to SEQ ID NO:482, and/or
(b) a variable light chain comprising an amino acid sequence with at least 80, 85, 90, 95, 96, 97, 98, or 99% sequence identity to SEQ ID NO:502.

Clause 42.5A. An anti-human ACTH antibody or antibody fragment according to Clause 40.5A, which comprises:
(a) a variable heavy chain having the amino acid sequence of SEQ ID NO:482, and/or
(b) a variable light chain having the amino acid sequence of SEQ ID NO:502.

Clause 43.5A. An anti-human ACTH antibody or antibody fragment according to Clause 40.5A, which comprises:
(a) a heavy chain having the amino acid sequence of SEQ ID NO:481, and/or
(b) a light chain having the amino acid sequence of SEQ ID NO:501.

Clause 40.6A. An human, humanized or chimerized anti-human ACTH antibody or antibody fragment according to any one of Clauses 1A-11A, which comprises:
(a) a variable heavy chain comprising a CDR1 sequence consisting of SEQ ID NO:524; a CDR2 sequence consisting of SEQ ID NO:526; and a CDR3 sequence consisting of SEQ ID NO:528; and/or
(b) a variable light chain comprising a CDR1 sequence consisting of SEQ ID NO:544; a CDR2 sequence consisting of SEQ ID NO:546; and a CDR3 sequence consisting of SEQ ID NO:548.

Clause 41.6A. An anti-human ACTH antibody or antibody fragment according to Clause 40.6A, which comprises:
(a) a variable heavy chain comprising an amino acid sequence with at least 80, 85, 90, 95, 96, 97, 98, or 99% sequence identity to SEQ ID NO:522, and/or
(b) a variable light chain comprising an amino acid sequence with at least 80, 85, 90, 95, 96, 97, 98, or 99% sequence identity to SEQ ID NO:542.

Clause 42.6A. An anti-human ACTH antibody or antibody fragment according to Clause 40.6A, which comprises:
(a) a variable heavy chain having the amino acid sequence of SEQ ID NO:522, and/or
(b) a variable light chain having the amino acid sequence of SEQ ID NO:542.

Clause 43.6A. An anti-human ACTH antibody or antibody fragment according to Clause 40.6A, which comprises:
(a) a heavy chain having the amino acid sequence of SEQ ID NO:521, and/or
(b) a light chain having the amino acid sequence of SEQ ID NO:541.

Clause 40.7A. An human, humanized or chimerized anti-human ACTH antibody or antibody fragment according to any one of Clauses 1A-11A, which comprises:
(a) a variable heavy chain comprising a CDR1 sequence consisting of SEQ ID NO:564; a CDR2 sequence consisting of SEQ ID NO:566; and a CDR3 sequence consisting of SEQ ID NO:568; and/or (b) a variable light chain comprising a CDR1 sequence consisting of SEQ ID NO:584; a CDR2 sequence consisting of SEQ ID NO:586; and a CDR3 sequence consisting of SEQ ID NO:588.

Clause 41.7A. An anti-human ACTH antibody or antibody fragment according to Clause 40.7A, which comprises:
(a) a variable heavy chain comprising an amino acid sequence with at least 80, 85, 90, 95, 96, 97, 98, or 99% sequence identity to SEQ ID NO:562, and/or
(b) a variable light chain comprising an amino acid sequence with at least 80, 85, 90, 95, 96, 97, 98, or 99% sequence identity to SEQ ID NO:582.

Clause 42.7A. An anti-human ACTH antibody or antibody fragment according to Clause 40.7A, which comprises:
(a) a variable heavy chain having the amino acid sequence of SEQ ID NO:562, and/or
(b) a variable light chain having the amino acid sequence of SEQ ID NO:582.

Clause 43.7A. An anti-human ACTH antibody or antibody fragment according to Clause 40.7A, which comprises:
(a) a heavy chain having the amino acid sequence of SEQ ID NO:561, and/or
(b) a light chain having the amino acid sequence of SEQ ID NO:581.

Clause 40.8A. An human, humanized or chimerized anti-human ACTH antibody or antibody fragment according to any one of Clauses 1A-11A, which comprises:
(a) a variable heavy chain comprising a CDR1 sequence consisting of SEQ ID NO:604; a CDR2 sequence consisting of SEQ ID NO:606; and a CDR3 sequence consisting of SEQ ID NO:608; and/or
(b) a variable light chain comprising a CDR1 sequence consisting of SEQ ID NO:624; a CDR2 sequence consisting of SEQ ID NO:626; and a CDR3 sequence consisting of SEQ ID NO:628.

Clause 41.8A. An anti-human ACTH antibody or antibody fragment according to Clause 40.8A, which comprises:
(a) a variable heavy chain comprising an amino acid sequence with at least 80, 85, 90, 95, 96, 97, 98, or 99% sequence identity to SEQ ID NO:602, and/or
(b) a variable light chain comprising an amino acid sequence with at least 80, 85, 90, 95, 96, 97, 98, or 99% sequence identity to SEQ ID NO:622.

Clause 42.8A. An anti-human ACTH antibody or antibody fragment according to Clause 40.8A, which comprises:
(a) a variable heavy chain having the amino acid sequence of SEQ ID NO:602, and/or
(b) a variable light chain having the amino acid sequence of SEQ ID NO:622.

Clause 43.8A. An anti-human ACTH antibody or antibody fragment according to Clause 40.8A, which comprises:
(a) a heavy chain having the amino acid sequence of SEQ ID NO:601, and/or
(b) a light chain having the amino acid sequence of SEQ ID NO:621.

Clause 40.9A. An human, humanized or chimerized anti-human ACTH antibody or antibody fragment according to any one of Clauses 1A-11A, which comprises:
(a) a variable heavy chain comprising a CDR1 sequence consisting of SEQ ID NO:644; a CDR2 sequence consisting of SEQ ID NO:646; and a CDR3 sequence consisting of SEQ ID NO:648; and/or
(b) a variable light chain comprising a CDR1 sequence consisting of SEQ ID NO:664; a CDR2 sequence consisting of SEQ ID NO:666; and a CDR3 sequence consisting of SEQ ID NO:668.

Clause 41.9A. An anti-human ACTH antibody or antibody fragment according to Clause 40.9A, which comprises:
(a) a variable heavy chain comprising an amino acid sequence with at least 80, 85, 90, 95, 96, 97, 98, or 99% sequence identity to SEQ ID NO:642, and/or
(b) a variable light chain comprising an amino acid sequence with at least 80, 85, 90, 95, 96, 97, 98, or 99% sequence identity to SEQ ID NO:662.

Clause 42.9A. An anti-human ACTH antibody or antibody fragment according to Clause 40.9A, which comprises:
(a) a variable heavy chain having the amino acid sequence of SEQ ID NO:642, and/or
(b) a variable light chain having the amino acid sequence of SEQ ID NO:662.

Clause 43.9A. An anti-human ACTH antibody or antibody fragment according to Clause 40.9A, which comprises:
(a) a heavy chain having the amino acid sequence of SEQ ID NO:641, and/or
(b) a light chain having the amino acid sequence of SEQ ID NO:661.

Clause 44A. The anti-human ACTH antibody or antibody fragment of any one of Clauses 1A-43.9A, wherein the antibody or antibody fragment is selected from the group consisting of scFvs, camelbodies, nanobodies, IgNAR, Fab fragments, Fab' fragments, MetMab like antibodies, monovalent antibody fragments, and F(ab')$_2$ fragments.

Clause 45A. The anti-human ACTH antibody or antibody fragment of any one of Clauses 1A-44A, wherein the antibody or antibody fragment substantially or entirely lacks N-glycosylation and/or O-glycosylation.

Clause 46A. The anti-human ACTH antibody or antibody fragment of any one of Clauses 1A-45A, wherein the antibody or antibody fragment comprises a human constant domain.

Clause 47A. The anti-human ACTH antibody or antibody fragment of Clause 46A, wherein the antibody is an IgG1, IgG2, IgG3, or IgG4 antibody.

Clause 48A. The anti-human ACTH antibody or antibody fragment of any one of Clauses 1A-47A, wherein the antibody or antibody fragment comprises an Fc region that has been modified to alter at least one of effector function, half-life, proteolysis, or glycosylation.

Clause 49A. The anti-human ACTH antibody or antibody fragment of Clause 48A, wherein the Fc region contains one or more mutations that alters or eliminates N- and/or O-glycosylation.

Clause 50A. The anti-human ACTH antibody or antibody fragment of any one of Clauses 1A-49A, wherein the antibody or antibody fragment is a humanized antibody or antibody fragment.

Clause 51A. The anti-human ACTH antibody or antibody fragment of any one of Clauses 1A-50A, wherein the antibody or antibody fragment binds to ACTH with a binding affinity ($K_D$) of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M, e.g., as determined by surface plasmon resonance (e.g., BIAcore®) at 25o or 37° C.

Clause 52A. The anti-human ACTH antibody or antibody fragment of any one of Clauses 1A-51A, wherein the antibody or antibody fragment binds to ACTH with a binding affinity ($K_D$) of less than or equal to $5\times10^{-10}$ M, $10^{-10}$ M, $5\times10^{-11}$ M, $10^{-11}$ M, $5\times10^{-12}$ M, or $10^{-12}$ M.

Clause 53A. The anti-human ACTH antibody or antibody fragment of any one of Clauses 1A-52A, which binds to ACTH with an off-rate ($k_d$) of less than or equal to $5 \times 10^{-4}$ s$^{-1}$, $10^{-4}$ s$^{-1}$, $5 \times 10^{-5}$ s$^{-1}$, or $10^{-5}$ s$^{-1}$.

Clause 54A. The anti-human ACTH antibody or antibody fragment of any one of Clauses 1A-53A, wherein the antibody or antibody fragment is directly or indirectly attached to a detectable label or therapeutic agent.

Clause 55A. The anti-human ACTH antibody or antibody fragment of any one of Clauses 1A-54A, which when administered to a human subject inhibits or neutralizes at least one biological effect elicited by ACTH.

Clause 56A. The anti-human ACTH antibody or antibody fragment of any one of Clauses 1A-55A, which neutralizes or inhibits ACTH activation of MC2R.

Clause 57A. The anti-human ACTH antibody or antibody fragment of any one of Clauses 1A-55A, which neutralizes or inhibits ACTH activation of at least one of MC1R, MC2R, MC3R, MC4R and MC5R or any combination thereof.

Clause 58A. The anti-human ACTH antibody or antibody fragment of any one of Clauses 1A-55A, which neutralizes or inhibits ACTH activation of each of MC2R, MC3R and MC4R.

Clause 59A. The anti-human ACTH antibody or antibody fragment of any one of Clauses 1A-55A, which inhibits ACTH-induced cortisol, corticosterone and/or aldosterone secretion.

Clause 60A. The anti-human ACTH antibody or antibody fragment of any one of Clauses 1A-55A, which when administered to a human subject reduces plasma cortisol, aldosterone and/or corticosterone levels.

Clause 61A. The anti-human ACTH antibody or antibody fragment of any one of Clauses 1A-60A, wherein the antibody or antibody fragment is capable of inhibiting the binding of ACTH to a MCR.

Clause 62A. The anti-human ACTH antibody or antibody fragment of Clause 61A, wherein the MCR is at least one of MC1R, MC2R, MC3R, MC4R and MC5R; at least one of MC2R, MC3R, and MC4R; each of MC2R, MC3R, and MC4R; or each of MC1R, MC2R, MC3R, MC4R and MC5R.

Clause 63A. The anti-human ACTH antibody or antibody fragment of any one of Clauses 1A-62A, wherein the antibody or antibody fragment binds to ACTH with a $K_D$ that is less than about 100 nM.

Clause 64A. The anti-human ACTH antibody or antibody fragment of any one of Clauses 1A-62A, which binds to ACTH with a $K_D$ that is less than about 100 pM.

Clause 65A. The anti-human ACTH antibody or antibody fragment of any one of Clauses 1A-62A, which binds to ACTH with a $K_D$ that is less than about 50 pM.

Clause 66A. The anti-human ACTH antibody or antibody fragment of any one of Clauses 1A-62A, which binds to ACTH with a $K_D$ that is less than about 25 pM.

Clause 67A. The anti-human ACTH antibody or antibody fragment of any one of Clauses 1A-62A, which binds to ACTH with a $K_D$ that is between about 10 pM and about 100 pM.

Clause 68A. The anti-human ACTH antibody or antibody fragment of any one of Clauses 1A-62A, which binds to ACTH with a $K_D$ that is less than about 40 nM.

Clause 69A. The anti-human ACTH antibody or antibody fragment of any one of Clauses 1A-68A, which has stronger affinity for ACTH$_{1-39}$ as compared to alpha-MSH or CLIP and/or does not bind to alpha-MSH.

Clause 70A. The anti-human ACTH antibody or antibody fragment of Clause 69A, wherein the affinity of said antibody or antibody fragment to ACTH$_{1-39}$ is at least 10-fold, 100-fold, 1000-fold or more stronger than the affinity of said antibody or antibody fragment to alpha-MSH or CLIP (i.e., the $K_D$ for ACTH is numerically lower than the $K_D$ for alpha-MSH or CLIP by at least 10-fold, 100-fold, 1000-fold or more).

Clause 71A. The anti-human ACTH antibody or antibody fragment of any one of Clauses 1A-70A, wherein the antibody or antibody fragment is attached to at least one effector moiety.

Clause 72A. The anti-human ACTH antibody or antibody fragment of Clause 71A, wherein effector moiety comprises a chemical linker.

Clause 73A. The anti-human ACTH antibody or antibody fragment of any one of Clauses 1A-72A, wherein the antibody or antibody fragment is attached to one or more detectable moieties.

Clause 74A. The anti-human ACTH antibody or antibody fragment of Clause 73A, wherein detectable moiety comprises a fluorescent dye, enzyme, substrate, bioluminescent material, radioactive material, chemiluminescent moiety, or mixtures thereof.

Clause 75A. The anti-human ACTH antibody or antibody fragment of any one of Clauses 1A-74A, wherein the antibody or antibody fragment is attached to one or more functional moieties.

Clause 76A. An anti-idiotypic antibody produced against an anti-human ACTH antibody or antibody fragment according to any one of Clauses 1A-75A, which optionally, neutralizes one or more biological effects of the anti-human ACTH antibody to which it binds.

Clause 77A. A method of using the anti-idiotypic antibody of Clause 76A or another antibody that specifically binds said anti-human ACTH antibody to monitor the in vivo levels of said anti-ACTH antibody or antibody fragment in a subject or to neutralize said anti-ACTH antibody in a subject being administered said anti-ACTH antibody or antibody fragment or a method of using the anti-idiotypic antibody of Clause 76A or another antibody that specifically binds said anti-human ACTH antibody to neutralize the in vivo effects of said antibody in a subject in need thereof.

Clause 78A. A composition suitable for therapeutic, prophylactic, or a diagnostic use comprising a therapeutically, prophylactically or diagnostically effective amount of at least one anti-human ACTH antibody or antibody fragment or anti-idiotypic antibody according to any one of Clauses 1A-76A.

Clause 79A. The composition of Clause 78A, which is suitable for subcutaneous administration.

Clause 80A. The composition of Clause 78A, which is suitable for intravenous administration.

Clause 81A. The composition of Clause 78A, which is lyophilized.

Clause 82A. The composition of any one of Clauses 78A-81A, further comprising a pharmaceutically acceptable diluent, carrier, solubilizer, emulsifier, preservative, or mixture thereof.

Clause 83A. The composition of any one of Clauses 78A-82A, further comprising another active agent.

Clause 84A. The composition of Clause 83A, wherein (i) the other active agent is selected from the group consisting of ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®), or wherein the other active agent is selected from the group consisting of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), and Zestril (lisinopril), and/or (ii) the other active agent is selected from the group consisting of: corticosteroids, glucocorticoids, mineralocorticoids, cortisol (hydrocortisone), dexamethasone, cortisone, prednisone, prednisolone, methylprednisolone, dexamethasone, betamethasone, triamcinolone, beclometasone, fludrocortisone, fludrocortisone acetate, deoxycorticosterone, deoxycorticosterone acetate (DOCA), and aldosterone.

Clause 85A. The composition of any one of Clauses 79A-84A, which is lyophilized, stabilized and/or formulated for administration by injection.

Clause 86A. An isolated nucleic acid sequence or nucleic acid sequences encoding an anti-human ACTH antibody or antibody fragment or anti-idiotypic antibody according to any one of Clauses 1A-76A.

Clause 87A. A vector or vectors containing the isolated nucleic acid sequence or sequences of Clause 86A.

Clause 88A. A host cell comprising the isolated nucleic acid sequence or sequences of Clause 87A or the vector or vectors of Clause 87A.

Clause 89A. The host cell of Clause 88A, which is a mammalian, bacterial, fungal, yeast, avian or insect cell.

Clause 90A. The host cell of Clause 89A, which is a filamentous fungi or a yeast.

Clause 91A. The host cell of Clause 90A, wherein the yeast is selected from the from the following genera: *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis;* and *Zygosaccharomyces.*

Clause 92A. The host cell of Clause 91A, which is the yeast genus is *Pichia.*

Clause 93A. The host cell of Clause 92A, wherein the species of *Pichia* is selected from *Pichia pastoris, Pichia methanolica* and *Hansenula polymorpha (Pichia angusta).*

Clause 94A. A method of expressing an anti-human ACTH antibody or antibody fragment comprising culturing the host cell of any one of Clauses 89A-93A under conditions that provide for expression of said antibody or antibody fragment.

Clause 95A. The method of Clause 94A, wherein the host cell is a polyploid yeast culture that stably expresses and secretes into the culture medium at least 10-25 mg/liter of said antibody or antibody fragment.

Clause 96A. The method of Clause 95A, wherein said polyploid yeast is made by a method that comprises:

(i) introducing at least one expression vector containing one or more heterologous polynucleotides encoding said antibody operably linked to a promoter and a signal sequence into a haploid yeast cell;

(ii) producing by mating or spheroplast fusion a polyploid yeast from said first and/or second haploid yeast cell;

(iii) selecting polyploid yeast cells that stably express said antibody; and (iv) producing stable polyploid yeast cultures from said polyploid yeast cells that stably express said antibody into the culture medium.

Clause 97A. The method of Clause 96A, wherein said yeast is of the genus *Pichia.*

Clause 98A. A method for blocking, inhibiting or neutralizing one or more biological effects associated with ACTH comprising administering to a subject in need thereof an effective amount of an anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 99A. A method for treating or preventing a condition associated with elevated ACTH levels in a subject, comprising administering to a subject in need thereof an effective amount of an anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 100A. A method for treating or preventing a condition associated with elevated cortisol, aldosterone or corticosterone levels in a subject, comprising administering to the subject in need thereof an effective amount of an anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 101A. The method of any one of Clauses 97A-100A, wherein (i) the condition is selected from the group consisting of ACTH-driven hypercortisolism (Cushing's Disease and/or Cushing's Syndrome), obesity, diabetes, Parkinson's disease, sleep disorders, e.g., insomnia, sleep apnea, and narcolepsy, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophy, hypertension, hyperinsulinemia, cognitive dysfunction, Alzheimer's disease, galactorrhea, stress related conditions, impaired cardiac function, exercise intolerance, heart failure and other cardiac conditions, metabolic syndrome, hyperaldosteronism, Conn's syndrome and familial hyperaldosteronism, or (ii) wherein the condition comprises congenital adrenal hyperplasia (CAH), Classical CAH, or Nonclassical CAH or (iii) wherein the condition comprises familial glucocorticoid deficiency (FGD) or (iv) wherein the condition comprises Allgrove syndrome, bilateral adrenalectomy, or Nelson's syndrome.

Clause 102A. A method for neutralizing ACTH-induced MCR signaling, comprising administering to a subject in need thereof an effective amount of an anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 103A. A method for inhibiting ACTH-induced cortisol, aldosterone or corticosterone secretion, comprising administering to a subject in need thereof an effective amount of an anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 104A. A method for reducing ACTH-induced plasma cortisol, aldosterone or corticosterone levels in a subject in need thereof, comprising administering to a subject in need thereof an effective amount of a human, humanized or chimerized anti-human adrenocorticotrophic hormone ("ACTH") antibody or antibody fragment that specifically binds to the same linear or conformational epitope(s) and/or competes for binding to the same linear or conformational epitope(s) on human ACTH as an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 105A. The method of any one of Clauses 98A-104A, wherein the antibody is a human, humanized or chimerized anti-ACTH antibody or antibody fragment.

Clause 106A. The method of any one of Clauses 98A-105A, wherein the antibody or antibody fragment substantially does not interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH ($ACTH_{18-39}$).

Clause 107A. The method of any one of Clauses 98A-106A, wherein the at least one isolated anti-human ACTH antibody or antibody fragment inhibits the binding of ACTH to a MCR.

Clause 108A. The method of Clause 107A, wherein the MCR is selected from the group consisting of MC1R, MC2R, MC3R, MC4R and MC5R.

Clause 109A. The method of any one of Clauses 98A-108A, wherein said epitope(s) is identified using a binding assay that detects the binding of said anti-human ACTH antibody or antibody fragment to one or more peptides in a library of overlapping linear peptide fragments that span the full length of human ACTH.

Clause 110A. The method of any one of Clauses 98-109A, which contains at least 2 complementarity determining regions (CDRs) of an anti-human ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 111A. The method of any one of Clauses 98A-110A, which contains at least 3 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 112A. The method of any one of Clauses 98A-110A, which contains at least 4 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 113A. The method of any one of Clauses 98A-110A, which contains at least 5 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 114A. The method of any one of Clauses 98A-110A, which contains all 6 CDRs of an anti-ACTH antibody selected from the group consisting of Ab13, Ab15, Ab17, Ab1.H, Ab2.H, Ab3.H, Ab4.H, Ab6.H, Ab7.H, Ab7A.H, Ab10.H, Ab11.H, Ab11A.H, Ab12.H, Ab13.H, Ab15.H, and Ab17.H.

Clause 115A. The method of any one of Clauses 98A-110A, wherein the at least one isolated anti-human ACTH antibody or antibody fragment comprises:

(a) a variable heavy chain comprising a CDR1 sequence consisting of SEQ ID NO:4; a CDR2 sequence consisting of SEQ ID NO:6; and a CDR3 sequence consisting of SEQ ID NO:8; and/or a variable light chain comprising a CDR1 sequence consisting of SEQ ID NO:24; a CDR2 sequence consisting of SEQ ID NO:26; and a CDR3 sequence consisting of SEQ ID NO:28;

(b) a variable heavy chain comprising an amino acid sequence with at least 80, 85, 90, 95, 96, 97, 98, or 99% sequence identity to SEQ ID NO:2; and/or a variable light chain comprising an amino acid sequence with at least 80, 85, 90, 95, 96, 97, 98, or 99% sequence identity to SEQ ID NO:22;

(c) a variable heavy chain having the amino acid sequence of SEQ ID NO:2; and/or a variable light chain having the amino acid sequence of SEQ ID NO:22; or (d) a heavy chain having the amino acid sequence of SEQ ID NO: 1, and/or a light chain having the amino acid sequence of SEQ ID NO:21.

Clause 116A. The method of any one of Clauses 98A-110A, wherein the at least one isolated anti-human ACTH antibody or antibody fragment comprises:

(a) a variable heavy chain comprising a CDR1 sequence consisting of SEQ ID NO:44; a CDR2 sequence consisting of SEQ ID NO:46; and a CDR3 sequence consisting of SEQ ID NO:48, and/or a variable light chain comprising a CDR1 sequence consisting of SEQ ID NO:64; a CDR2 sequence consisting of SEQ ID NO:66; and a CDR3 sequence consisting of SEQ ID NO:68;

(b) a variable heavy chain comprising an amino acid sequence with at least 80, 85, 90, 95, 96, 97, 98, or 99% sequence identity to SEQ ID NO:42, and/or a variable light chain comprising an amino acid sequence with at least 80, 85, 90, 95, 96, 97, 98, or 99% sequence identity to SEQ ID NO:62;

(c) a variable heavy chain having the amino acid sequence of SEQ ID NO:42, and/or a variable light chain having the amino acid sequence of SEQ ID NO:62; or (d) a heavy chain having the amino acid sequence of SEQ ID NO:41, and/or a light chain having the amino acid sequence of SEQ ID NO:61.

Clause 117A. The method of any one of Clauses 98A-110A, wherein the at least one isolated anti-human ACTH antibody or antibody fragment comprises:

(a) a variable heavy chain comprising a CDR1 sequence consisting of SEQ ID NO:84; a CDR2 sequence consisting of SEQ ID NO:86; and a CDR3 sequence consisting of SEQ ID NO:88, and/or a variable light chain comprising a CDR1 sequence consisting of SEQ ID NO: 104; a CDR2 sequence consisting of SEQ ID NO: 106; and a CDR3 sequence consisting of SEQ ID NO: 108;

(b) a variable heavy chain comprising an amino acid sequence with at least 80, 85, 90, 95, 96, 97, 98, or 99% sequence identity to SEQ ID NO:82, and/or a variable light chain comprising an amino acid sequence with at least 80, 85, 90, 95, 96, 97, 98, or 99% sequence identity to SEQ ID NO: 102;

(c) a variable heavy chain having the amino acid sequence of SEQ ID NO:82, and/or a variable light chain having the amino acid sequence of SEQ ID NO: 102; or (d) a heavy chain having the amino acid sequence of SEQ ID NO:81, and/or a light chain having the amino acid sequence of SEQ ID NO:101.

Clause 118A. The method of any one of Clauses 98A-110A, wherein the at least one isolated anti-human ACTH antibody or antibody fragment comprises:

(a) a variable heavy chain comprising a CDR1 sequence consisting of SEQ ID NO: 124; a CDR2 sequence consisting of SEQ ID NO: 126 and a CDR3 sequence consisting of SEQ ID NO: 128, and/or a variable light chain comprising a CDR1 sequence consisting of SEQ ID NO: 144; a CDR2 sequence consisting of SEQ ID NO: 146; and a CDR3 sequence consisting of SEQ ID NO: 148;

(b) a variable heavy chain comprising an amino acid sequence with at least 80, 85, 90, 95, 96, 97, 98, or 99% sequence identity to SEQ ID NO: 122 and/or a variable light chain comprising an amino acid sequence with at least 80, 85, 90, 95, 96, 97, 98, or 99% sequence identity to SEQ ID NO: 142;

(c) a variable heavy chain having the amino acid sequence of SEQ ID NO: 122, and/or a variable light chain having the amino acid sequence of SEQ ID NO: 142; or (d) a heavy chain having the amino acid sequence of SEQ ID NO:121, and/or a light chain having the amino acid sequence of SEQ ID NO: 141.

Clause 119A. The method of any one of Clauses 98A-110A, wherein the at least one isolated anti-human ACTH antibody or antibody fragment comprises:

(a) a variable heavy chain comprising a CDR1 sequence consisting of SEQ ID NO: 164; a CDR2 sequence consisting of SEQ ID NO: 166; and a CDR3 sequence consisting of SEQ ID NO: 168, and/or a variable light chain comprising a CDR1 sequence consisting of SEQ ID NO:184; a CDR2 sequence consisting of SEQ ID NO: 186; and a CDR3 sequence consisting of SEQ ID NO: 188;

(b) a variable heavy chain comprising an amino acid sequence with at least 80, 85, 90, 95, 96, 97, 98, or 99% sequence identity to SEQ ID NO: 162, and/or a variable light chain comprising an amino acid sequence with at least 80, 85, 90, 95, 96, 97, 98, or 99% sequence identity to SEQ ID NO: 182;

(c) a variable heavy chain having the amino acid sequence of SEQ ID NO: 162, and/or a variable light chain having the amino acid sequence of SEQ ID NO: 182; or (d) a heavy chain having the amino acid sequence of SEQ ID NO:161, and/or a light chain having the amino acid sequence of SEQ ID NO: 181.

Clause 120A. The method of any one of Clauses 98A-110A, wherein the at least one isolated anti-human ACTH antibody or antibody fragment comprises:

(a) a variable heavy chain comprising a CDR1 sequence consisting of SEQ ID NO:204; a CDR2 sequence consisting of SEQ ID NO:206; and a CDR3 sequence consisting of SEQ ID NO:208, and/or a variable light chain comprising a CDR1 sequence consisting of SEQ ID NO:224; a CDR2 sequence consisting of SEQ ID NO:226; and a CDR3 sequence consisting of SEQ ID NO:228;

(b) a variable heavy chain comprising an amino acid sequence with at least 80, 85, 90, 95, 96, 97, 98, or 99% sequence identity to SEQ ID NO:202 and/or a variable light chain comprising an amino acid sequence with at least 80, 85, 90, 95, 96, 97, 98, or 99% sequence identity to SEQ ID NO:222;

(c) a variable heavy chain having the amino acid sequence of SEQ ID NO:202, and/or a variable light chain having the amino acid sequence of SEQ ID NO:222; or (d) a heavy chain having the amino acid sequence of SEQ ID NO:201, and/or a light chain having the amino acid sequence of SEQ ID NO:221.

Clause 121A. The method of any one of Clauses 98A-110A, wherein the at least one isolated anti-human ACTH antibody or antibody fragment comprises:

(a) a variable heavy chain comprising a CDR1 sequence consisting of SEQ ID NO:244; a CDR2 sequence consisting of SEQ ID NO:246; and a CDR3 sequence consisting of SEQ ID NO:248, and/or a variable light chain comprising a CDR1 sequence consisting of SEQ ID NO:264; a CDR2 sequence consisting of SEQ ID NO:266; and a CDR3 sequence consisting of SEQ ID NO:268;

(b) a variable heavy chain comprising an amino acid sequence with at least 80, 85, 90, 95, 96, 97, 98, or 99% sequence identity to SEQ ID NO:242, and/or a variable light chain comprising an amino acid sequence with at least 80, 85, 90, 95, 96, 97, 98, or 99% sequence identity to SEQ ID NO:262;

(c) a variable heavy chain having the amino acid sequence of SEQ ID NO:242, and/or a variable light chain having the amino acid sequence of SEQ ID NO:262;

(d) a heavy chain having the amino acid sequence of SEQ ID NO:241, and/or a light chain having the amino acid sequence of SEQ ID NO:261.

Clause 122A. The method of any one of Clauses 98A-110A, wherein the at least one isolated anti-human ACTH antibody or antibody fragment comprises:

(a) a variable heavy chain comprising a CDR1 sequence consisting of SEQ ID NO:284; a CDR2 sequence consisting of SEQ ID NO:286; and a CDR3 sequence consisting of SEQ ID NO:288, and/or a variable light chain comprising a CDR1 sequence consisting of SEQ ID NO:304; a CDR2 sequence consisting of SEQ ID NO:306; and a CDR3 sequence consisting of SEQ ID NO:308;

(b) a variable heavy chain comprising an amino acid sequence with at least 80, 85, 90, 95, 96, 97, 98, or 99% sequence identity to SEQ ID NO:282, and/or a variable light chain comprising an amino acid sequence with at least 80, 85, 90, 95, 96, 97, 98, or 99% sequence identity to SEQ ID NO:302;

(c) a variable heavy chain having the amino acid sequence of SEQ ID NO:282, and/or a variable light chain having the amino acid sequence of SEQ ID NO:302;

(d) a heavy chain having the amino acid sequence of SEQ ID NO:281, and/or a light chain having the amino acid sequence of SEQ ID NO:301.

Clause 122.1A. The method of any one of Clauses 98A-110A, wherein the at least one isolated anti-human ACTH antibody or antibody fragment comprises:

(a) a variable heavy chain comprising a CDR1 sequence consisting of SEQ ID NO:324; a CDR2 sequence consisting of SEQ ID NO:326; and a CDR3 sequence consisting of SEQ ID NO:328, and/or a variable light chain comprising a CDR1 sequence consisting of SEQ ID NO:344; a CDR2 sequence consisting of SEQ ID NO:346; and a CDR3 sequence consisting of SEQ ID NO:348;

(b) a variable heavy chain comprising an amino acid sequence with at least 80, 85, 90, 95, 96, 97, 98, or 99% sequence identity to SEQ ID NO:322, and/or a variable light chain comprising an amino acid sequence with at least 80, 85, 90, 95, 96, 97, 98, or 99% sequence identity to SEQ ID NO:342;

(c) a variable heavy chain having the amino acid sequence of SEQ ID NO:322, and/or a variable light chain having the amino acid sequence of SEQ ID NO:342;

(d) a heavy chain having the amino acid sequence of SEQ ID NO:321, and/or a light chain having the amino acid sequence of SEQ ID NO:341.

Clause 122.2A. The method of any one of Clauses 98A-110A, wherein the at least one isolated anti-human ACTH antibody or antibody fragment comprises:

(a) a variable heavy chain comprising a CDR1 sequence consisting of SEQ ID NO:364; a CDR2 sequence consisting of SEQ ID NO:366; and a CDR3 sequence consisting of SEQ ID NO:368, and/or a variable light chain comprising a CDR1 sequence consisting of SEQ ID NO:384; a CDR2 sequence consisting of SEQ ID NO:386; and a CDR3 sequence consisting of SEQ ID NO:388;

(b) a variable heavy chain comprising an amino acid sequence with at least 80, 85, 90, 95, 96, 97, 98, or 99% sequence identity to SEQ ID NO:362, and/or a variable light chain comprising an amino acid sequence with at least 80, 85, 90, 95, 96, 97, 98, or 99% sequence identity to SEQ ID NO:382;

(c) a variable heavy chain having the amino acid sequence of SEQ ID NO:362, and/or a variable light chain having the amino acid sequence of SEQ ID NO:382;

(d) a heavy chain having the amino acid sequence of SEQ ID NO:361, and/or a light chain having the amino acid sequence of SEQ ID NO:381.

Clause 122.3A. The method of any one of Clauses 98A-110A, wherein the at least one isolated anti-human ACTH antibody or antibody fragment comprises:

(a) a variable heavy chain comprising a CDR1 sequence consisting of SEQ ID NO:404; a CDR2 sequence consisting of SEQ ID NO:406; and a CDR3 sequence consisting of SEQ ID NO:408, and/or a variable light chain comprising a CDR1 sequence consisting of SEQ ID NO:424; a CDR2 sequence consisting of SEQ ID NO:426; and a CDR3 sequence consisting of SEQ ID NO:428;

(b) a variable heavy chain comprising an amino acid sequence with at least 80, 85, 90, 95, 96, 97, 98, or 99% sequence identity to SEQ ID NO:402, and/or a variable light chain comprising an amino acid sequence with at least 80, 85, 90, 95, 96, 97, 98, or 99% sequence identity to SEQ ID NO:422;

(c) a variable heavy chain having the amino acid sequence of SEQ ID NO:402, and/or a variable light chain having the amino acid sequence of SEQ ID NO:422;

(d) a heavy chain having the amino acid sequence of SEQ ID NO:401, and/or a light chain having the amino acid sequence of SEQ ID NO:421.

Clause 122.4A. The method of any one of Clauses 98A-110A, wherein the at least one isolated anti-human ACTH antibody or antibody fragment comprises:

(a) a variable heavy chain comprising a CDR1 sequence consisting of SEQ ID NO:444; a CDR2 sequence consisting of SEQ ID NO:446; and a CDR3 sequence consisting of SEQ ID NO:448, and/or a variable light chain comprising a CDR1 sequence consisting of SEQ ID NO:464; a CDR2 sequence consisting of SEQ ID NO:466; and a CDR3 sequence consisting of SEQ ID NO:468;

(b) a variable heavy chain comprising an amino acid sequence with at least 80, 85, 90, 95, 96, 97, 98, or 99% sequence identity to SEQ ID NO:442, and/or a variable light chain comprising an amino acid sequence with at least 80, 85, 90, 95, 96, 97, 98, or 99% sequence identity to SEQ ID NO:462;

(c) a variable heavy chain having the amino acid sequence of SEQ ID NO:442, and/or a variable light chain having the amino acid sequence of SEQ ID NO:462;

(d) a heavy chain having the amino acid sequence of SEQ ID NO:441, and/or a light chain having the amino acid sequence of SEQ ID NO:461.

Clause 122.5A. The method of any one of Clauses 98A-110A, wherein the at least one isolated anti-human ACTH antibody or antibody fragment comprises:

(a) a variable heavy chain comprising a CDR1 sequence consisting of SEQ ID NO:484; a CDR2 sequence consisting of SEQ ID NO:486; and a CDR3 sequence consisting of SEQ ID NO:488, and/or a variable light chain comprising a CDR1 sequence consisting of SEQ ID NO:504; a CDR2 sequence consisting of SEQ ID NO:506; and a CDR3 sequence consisting of SEQ ID NO:508;

(b) a variable heavy chain comprising an amino acid sequence with at least 80, 85, 90, 95, 96, 97, 98, or 99% sequence identity to SEQ ID NO:482, and/or a variable light chain comprising an amino acid sequence with at least 80, 85, 90, 95, 96, 97, 98, or 99% sequence identity to SEQ ID NO:502;

(c) a variable heavy chain having the amino acid sequence of SEQ ID NO:482, and/or a variable light chain having the amino acid sequence of SEQ ID NO:502;

(d) a heavy chain having the amino acid sequence of SEQ ID NO:481, and/or a light chain having the amino acid sequence of SEQ ID NO:501.

Clause 122.6A. The method of any one of Clauses 98A-110A, wherein the at least one isolated anti-human ACTH antibody or antibody fragment comprises:

(a) a variable heavy chain comprising a CDR1 sequence consisting of SEQ ID NO:524; a CDR2 sequence consisting of SEQ ID NO:526; and a CDR3 sequence consisting of SEQ ID NO:528, and/or a variable light chain comprising a CDR1 sequence consisting of SEQ ID NO:544; a CDR2 sequence consisting of SEQ ID NO:546; and a CDR3 sequence consisting of SEQ ID NO:548;

(b) a variable heavy chain comprising an amino acid sequence with at least 80, 85, 90, 95, 96, 97, 98, or 99% sequence identity to SEQ ID NO:522, and/or a variable light chain comprising an amino acid sequence with at least 80, 85, 90, 95, 96, 97, 98, or 99% sequence identity to SEQ ID NO:542;

(c) a variable heavy chain having the amino acid sequence of SEQ ID NO:522, and/or a variable light chain having the amino acid sequence of SEQ ID NO:542;

(d) a heavy chain having the amino acid sequence of SEQ ID NO:521, and/or a light chain having the amino acid sequence of SEQ ID NO:541.

Clause 122.7A. The method of any one of Clauses 98A-110A, wherein the at least one isolated anti-human ACTH antibody or antibody fragment comprises:

(a) a variable heavy chain comprising a CDR1 sequence consisting of SEQ ID NO:564; a CDR2 sequence consisting of SEQ ID NO:566; and a CDR3 sequence consisting of SEQ ID NO:568, and/or a variable light chain comprising a CDR1 sequence consisting of SEQ ID NO:584; a CDR2 sequence consisting of SEQ ID NO:586; and a CDR3 sequence consisting of SEQ ID NO:588;

(b) a variable heavy chain comprising an amino acid sequence with at least 80, 85, 90, 95, 96, 97, 98, or 99% sequence identity to SEQ ID NO:562, and/or a variable light chain comprising an amino acid sequence with at least 80, 85, 90, 95, 96, 97, 98, or 99% sequence identity to SEQ ID NO:582;

(c) a variable heavy chain having the amino acid sequence of SEQ ID NO:562, and/or a variable light chain having the amino acid sequence of SEQ ID NO:582;

(d) a heavy chain having the amino acid sequence of SEQ ID NO:561, and/or a light chain having the amino acid sequence of SEQ ID NO:581.

Clause 122.8A. The method of any one of Clauses 98A-110A, wherein the at least one isolated anti-human ACTH antibody or antibody fragment comprises:

(a) a variable heavy chain comprising a CDR1 sequence consisting of SEQ ID NO:604; a CDR2 sequence consisting of SEQ ID NO:606; and a CDR3 sequence consisting of SEQ ID NO:608, and/or a variable light chain comprising a CDR1 sequence consisting of SEQ ID NO:624; a CDR2 sequence consisting of SEQ ID NO:626; and a CDR3 sequence consisting of SEQ ID NO:628;

(b) a variable heavy chain comprising an amino acid sequence with at least 80, 85, 90, 95, 96, 97, 98, or 99% sequence identity to SEQ ID NO:602, and/or a variable light chain comprising an amino acid sequence with at least 80, 85, 90, 95, 96, 97, 98, or 99% sequence identity to SEQ ID NO:622;

(c) a variable heavy chain having the amino acid sequence of SEQ ID NO:602, and/or a variable light chain having the amino acid sequence of SEQ ID NO:622;

(d) a heavy chain having the amino acid sequence of SEQ ID NO:601, and/or a light chain having the amino acid sequence of SEQ ID NO:621.

Clause 122.9A. The method of any one of Clauses 98A-110A, wherein the at least one isolated anti-human ACTH antibody or antibody fragment comprises:

(a) a variable heavy chain comprising a CDR1 sequence consisting of SEQ ID NO:644; a CDR2 sequence consisting of SEQ ID NO:646; and a CDR3 sequence consisting of SEQ ID NO:648, and/or a variable light chain comprising a CDR1 sequence consisting of SEQ ID NO:664; a CDR2 sequence consisting of SEQ ID NO:666; and a CDR3 sequence consisting of SEQ ID NO:668;

(b) a variable heavy chain comprising an amino acid sequence with at least 80, 85, 90, 95, 96, 97, 98, or 99% sequence identity to SEQ ID NO:642, and/or a variable light chain comprising an amino acid sequence with at least 80, 85, 90, 95, 96, 97, 98, or 99% sequence identity to SEQ ID NO:662;

(c) a variable heavy chain having the amino acid sequence of SEQ ID NO:642, and/or a variable light chain having the amino acid sequence of SEQ ID NO:662;

(d) a heavy chain having the amino acid sequence of SEQ ID NO:641, and/or a light chain having the amino acid sequence of SEQ ID NO:661.

Clause 123A. The method of any one of Clauses 98A-122.9A, wherein the at least one anti-human ACTH antibody or antibody fragment is selected from the group consisting of chimeric, humanized, and human antibodies or antibody fragments.

Clause 124A. The method of any one of Clauses 98A-123A, wherein the at least one anti-human ACTH antibody or antibody fragment is selected from the group consisting of scFvs, camelbodies, nanobodies, IgNAR, Fab fragments, Fab' fragments, MetMab like antibodies, monovalent antibody fragments, and F(ab')$_2$ fragments.

Clause 125A. The method of any one of Clauses 98A-124A, wherein the at least one anti-human ACTH antibody or antibody fragment substantially or entirely lacks N-glycosylation and/or 0-glycosylation.

Clause 126A. The method of any one of Clauses 98A-125A, wherein the at least one anti-human ACTH antibody or antibody fragment comprises a human constant domain.

Clause 127A. The method of any one of Clauses 98A-126A, wherein the at least one anti-human ACTH antibody or antibody fragment is an IgG1, IgG2, IgG3, or IgG4 antibody.

Clause 128A. The method of any one of Clauses 98A-127A, wherein the at least one anti-human ACTH antibody or antibody fragment comprises an Fc region that has been modified to alter at least one of effector function, half-life, proteolysis, or glycosylation.

Clause 129A. The method of Clause 128A, wherein the Fc region contains one or more mutations that alters or eliminates N- and/or O-glycosylation.

Clause 130A. The method of any one of Clauses 98A-129A, wherein the at least one anti-human ACTH antibody or antibody fragment is a humanized antibody or antibody fragment.

Clause 131A. The method of any one of Clauses 98A-130A, wherein the at least one anti-human ACTH antibody or antibody fragment binds to ACTH with a $K_D$ of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M.

Clause 132A. The method of any one of Clauses 98A-131A, wherein the at least one anti-human ACTH antibody or antibody fragment binds to ACTH with a $K_D$ of less than or equal to $5 \times 10^{-10}$ M, $10^{-10}$ M, $5 \times 10^{-11}$ M, $10^{-11}$ M, $5 \times 10^{-12}$ M, or $10^{-12}$ M.

Clause 133A. The method of any one of Clauses 98A-132A, wherein the at least one anti-human ACTH antibody or antibody fragment binds to ACTH with an off-rate ($k_d$) of less than or equal to $5 \times 10^{-4}$ s$^{-1}$, $10^{-4}$ s$^{-1}$, $5 \times 10^{5}$ s$^{-1}$, or $10^{-5}$ s$^{-1}$.

Clause 134A. The method of any one of Clauses 98A-133A, wherein the at least one anti-human ACTH antibody or antibody fragment is directly or indirectly attached to a therapeutic agent.

Clause 135A. The method of any one of Clauses 98A-134A, wherein the at least one anti-human ACTH antibody or antibody fragment is attached to one or more detectable moieties.

Clause 136A. The method of Clause 135A, wherein detectable moiety comprises a fluorescent dye, enzyme, substrate, bioluminescent material, radioactive material, chemiluminescent moiety, or mixtures thereof.

Clause 137A. The method of any one of Clauses 98A-136A, wherein the at least one anti-human ACTH antibody or antibody fragment is attached to one or more functional moieties.

Clause 138A. The method of any one of Clauses 98A-137A, wherein the at least one isolated anti-human ACTH antibody or antibody fragment reduces plasma cortisol, corticosterone and/or aldosterone levels.

Clause 139A. The method of any one of Clauses 98A-138A, wherein the method further comprises administering separately or co-administering another agent.

Clause 140A. The method of Clause 139A, wherein (i) the other agent is selected from the group consisting of keto-conazole (Nizoral®), aminoglutethimide (Cytadren®), metyrapone (Metopirone®), mitotane (Lysodren®) etomi-date (Amidate®), cyproheptadine (Periactin® or Peritol®), valproic acid (Depakote®), cabergoline (Dostinex®), pasir-eotide (Signifor®), rosiglitazone (Avandia®), conivaptan (Vaprisol®), tolvaptan (OPC-41061), lixivaptan (VPA-985), and satavaptan (SR121463, planned trade name Aquilda®), mifepristone (Korlym®), armodafinil (Nuvigil®) and modafinil (Provigil®) or wherein the other active agent is selected from the group consisting of: Accupril (quinapril), Aceon (perindopril), Adalat, Adalat CC, Aldactone (spirono-lactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibi-tors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (so-talol), BiDil (hydralazine with isosorbide dinitrate), bigu-anides, blood thinners, Brevibloc (esmolol), Bumex (bu-metanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl pep-tidase-4 inhibitors, diuretics, Dobutrex (dobutamine), drugs that suppress ACTH secretion, drugs that suppress cortisol secretion, dual angiotensin converting enzyme/neutral endo-peptidase (ACE/NEP) inhibitors, endothelin antagonists, endothelin receptor blockers, Esidrix (hydrochlorothiazide), etomidate (Amidate®), Fragmin, gemfibrozil (Lopid, Gem-cor), glucocorticoid receptor antagonists, heart failure drugs, Heparin, HMG-Co-A reductase inhibitors, holestyramine (Questran), IMDUR (isosorbide mononitrate), Inderal (pro-pranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furo-semide), lixivaptan (VPA-985), Lopressor, Lotensin (benazepril), Lovenox, Mavik (trandolapril), meglitinides, metyrapone (Metopirone®), Micardis (telmisartan), mife-pristone (Korlym®), mitotane (Lysodren®), Monopril (fos-inopril), neutral endopeptidase (NEP) inhibitors, Normo-dyne, Norvasc (amlodipine), obesity-reducing agents, Omacor, pantethine, pasireotide (Signifor®), Plendil (felo-dipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sor-bitrate (isosorbide dinitrate), statins, Streptokinase, Sular (nisoldipine), sulfonylurea, Tambocor (flecainide), Tenect-eplase, Tenormin (atenolol), thiazolidinediones, Tiazac (dil-tiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vaso-pressin antagonists, Vasotec (enalapril), Verelan, Verelan PM (verapamil), warfarin (Coumadin), Zaroxolyn (metola-zone), Zebeta (bisoprolol), and Zestril (lisinopril), and/or (ii) the other active agent is selected from the group consisting of: corticosteroids, glucocorticoids, mineralocorticoids, cor-tisol (hydrocortisone), dexamethasone, cortisone, pred-nisone, prednisolone, methylprednisolone, dexamethasone, betamethasone, triamcinolone, beclometasone, fludrocorti-sone, fludrocortisone acetate, deoxycorticosterone, deoxy-corticosterone acetate (DOCA), and aldosterone.

Clause 141A. The method of Clause 139A or 140A, wherein the antibody or antibody fragment or the composi-tion containing the antibody of antibody fragment and the at least one other agent are administered concurrently.

Clause 142A. The method of Clause 139A or 140A, wherein the antibody or antibody fragment is administered before or after the at least one other agent.

Clause 143A. The method of any one of Clauses 98A-138A, wherein the method further comprises one or more of supplemental oxygen, continuous positive airway pressure (CPAP), bilevel positive airway pressure (BPAP), expiratory positive airway pressure (EPAP), adaptive servo-ventilation (ASV), oral applicanes, uvulopalatopharyngoplasty (UPPP), maxillomandibular advancement, nasal surgery, and removal of tonsils and/or adenoids.

Clause 1B. A human, humanized or chimerized anti-human adrenocorticotrophic hormone ("ACTH") antibody or antibody fragment.

Clause 2B. A human, humanized or chimerized anti-ACTH antibody or antibody fragment according to Clause 1B, which substantially does not interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH (ACTH) (Corticotrophin-Like Intermediate Peptide or "CLIP").

Clause 3B. The human, humanized or chimerized anti-ACTH antibody or antibody fragment according to Clause 1B, which binds to $ACTH_{1-39}$ with a binding affinity ($K_D$) at least 10-fold, 100-fold, 1000-fold or 10,000-fold stronger than the binding affinity of said antibody or antibody fragment to (i) $ACTH_{1-13}$ and/or alpha-MSH, and/or (ii) CLIP (i.e., a numerically lower $K_D$ for $ACTH_{1-39}$ by at least 10-fold, 100-fold, 1000-fold or 10,000-fold relative to the $K_D$ for $ACTH_{1-13}$ and/or alpha-MSH and/or CLIP).

Clause 4B. A human, humanized or chimerized anti-ACTH antibody or antibody fragment of any one of Clauses 1B-3B, which is a humanized antibody or humanized antibody fragment.

Clause 5B. A human, humanized or chimerized anti-ACTH antibody or antibody fragment of any one of Clauses 1B-3B, which is a human antibody or human antibody fragment.

Clause 6B. A human, humanized or chimerized anti-ACTH antibody or antibody fragment of any one of Clauses 1B-5B, which is selected from the group consisting of scFvs, camelbodies, nanobodies, IgNAR, Fab fragments, Fab' fragments, MetMab like antibodies, monovalent antibody fragments, and $F(ab')_2$ fragments.

Clause 7B. A human, humanized or chimerized anti-ACTH antibody or antibody fragment of any one of Clauses 1B-6B, which substantially or entirely lacks N-glycosylation and/or O-glycosylation.

Clause 8B. A human, humanized or chimerized anti-ACTH antibody or antibody fragment of any one of Clauses 1B-7B, which comprises a human constant domain.

Clause 9B. A human, humanized or chimerized anti-ACTH antibody or antibody fragment of Clause 8B, which is an IgG1, IgG2, IgG3, or IgG4 antibody.

Clause 10B. A human, humanized or chimerized anti-ACTH antibody or antibody fragment of any one of Clauses 1B-9B, which comprises an Fc region that has been modified to alter at least one of effector function, half-life, proteolysis, or glycosylation.

Clause 11B. A human, humanized or chimerized anti-ACTH antibody or antibody fragment of Clause 10B, wherein the Fc region contains one or more mutations that alters or eliminates N- and/or 0-glycosylation.

Clause 12B. A human, humanized or chimerized anti-ACTH antibody or antibody fragment of any one of Clauses 1B-11B, which binds to ACTH with a $K_D$ of less than or equal to $5 \times 10^{-5}$ M, $10^{-5}$ M, $5 \times 10^{-6}$ M, $10^{-6}$ M, $5 \times 10^{-7}$ M, $10^{-7}$ M, $5 \times 10^{-8}$ M, $10^{-8}$ M, $5 \times 10^{-9}$ M, $10^{-9}$ M, $5 \times 10^{-10}$ M, $10^{-10}$ M, $5 \times 10^{-11}$ M, $10^{-11}$ M, $5 \times 10^{-12}$ M, $10^{-12}$ M, $5 \times 10^{-13}$ M, or $10^{-13}$ M.

Clause 13B. A human, humanized or chimerized anti-ACTH antibody or antibody fragment of any one of Clauses 1B-12B, which binds to ACTH with a $K_D$ of less than or equal to $5 \times 10^{-10}$ M, $10^{-10}$ M, $5 \times 10^{-11}$ M, $10^{-11}$ M, $5 \times 10^{-12}$ M, or $10^{-12}$ M.

Clause 14B. A human, humanized or chimerized anti-ACTH antibody or antibody fragment of any one of Clauses 1B-13B, which binds to ACTH with an off-rate (kd) of less than or equal to $5 \times 10^{-4}$ $s^{-1}$, $10^{-4}$ $s^{-1}$, $5 \times 10^5$ $s^{-1}$, or $10^{-5}$ $s^{-1}$.

Clause 15B. A human, humanized or chimerized anti-ACTH antibody or antibody fragment of any one of Clauses 1B-14B, which binds to ACTH with a $K_D$ of less than about 100 nM, less than about 10 nM, less than about 1 nM, less than about 100 pM, less than about 50 pM, less than about 40 pM, less than about 25 pM, less than about 1 pM, between about 10 pM and about 100 pM, between about 1 pM and about 100 pM, or between about 1 pM and about 10 pM.

Clause 16B. The anti-human ACTH antibody or antibody fragment of any one of Clauses 1B-15B, wherein the antibody or antibody fragment is directly or indirectly attached to a detectable label or therapeutic agent.

Clause 17B. The anti-human ACTH antibody or antibody fragment of any one of Clauses 1B-16B, which when administered to a human subject inhibits or neutralizes at least one biological effect elicited by ACTH.

Clause 18B. The anti-human ACTH antibody or antibody fragment of any one of Clauses 1B-17B, which neutralizes or inhibits ACTH activation of MC2R.

Clause 19B. The anti-human ACTH antibody or antibody fragment of any one of Clauses 1B-17B, which neutralizes or inhibits ACTH activation of at least one of MC2R, MC3R, MC4R and MC5R.

Clause 20B. The anti-human ACTH antibody or antibody fragment of any one of Clauses 1B-17B, which neutralizes or inhibits ACTH activation of each of MC2R, MC3R and MC4R.

Clause 21B. The anti-human ACTH antibody or antibody fragment of any one of Clauses 1B-17B, which inhibits ACTH-induced corticosterone secretion.

Clause 22B. The anti-human ACTH antibody or antibody fragment of any one of Clauses 1B-17B, which when administered to a human subject reduces plasma cortisol, corticosterone and/or aldosterone levels.

Clause 23B. The anti-human ACTH antibody or antibody fragment of any one of Clauses 1B-22B, wherein the antibody or antibody fragment is capable of inhibiting the binding of ACTH to a MCR.

Clause 24B. The anti-human ACTH antibody or antibody fragment of Clause 23B, wherein the MCR is at least one of MC1R, MC2R, MC3R, MC4R and MC5R; at least one of MC2R, MC3R, and MC4R; each of MC2R, MC3R, and MC4R; or each of MC1R, MC2R, MC3R, MC4R and MC5R.

Clause 25B. The anti-human ACTH antibody or antibody fragment of any one of Clauses 1B-24B, wherein the antibody or antibody fragment binds to ACTH with a $K_D$ that is less than about 100 nM.

Clause 26B. The anti-human ACTH antibody or antibody fragment of any one of Clauses 1B-24B, which binds to ACTH with a $K_D$ that is less than about 100 pM.

Clause 27B. The anti-human ACTH antibody or antibody fragment of any one of Clauses 1B-24B, which binds to ACTH with a $K_D$ that is less than about 50 pM.

Clause 28B. The anti-human ACTH antibody or antibody fragment of any one of Clauses 1B-24B, which binds to ACTH with a $K_D$ that is less than about 25 pM.

Clause 29B. The anti-human ACTH antibody or antibody fragment of any one of Clauses 1B-24B, which binds to ACTH with a $K_D$ that is between about 10 pM and about 100 pM.

Clause 30B. The anti-human ACTH antibody or antibody fragment of any one of Clauses 1B-24B, which binds to ACTH with a $K_D$ that is less than about 40 nM.

Clause 31B. The anti-human ACTH antibody or antibody fragment of any one of Clauses 1B-30B, which has stronger affinity for $ACTH_{1-39}$ as compared to alpha-MSH or CLIP and/or does not bind to alpha-MSH or CLIP.

Clause 32B. The anti-human ACTH antibody or antibody fragment of any one of Clauses 1B-31B, wherein the antibody or antibody fragment is attached to at least one effector moiety.

Clause 33B. The anti-human ACTH antibody or antibody fragment of Clause 32B, wherein effector moiety comprises a chemical linker.

Clause 34B. The anti-human ACTH antibody or antibody fragment of any one of Clauses 1B-33B, wherein the antibody or antibody fragment is attached to one or more detectable moieties.

Clause 35B. The anti-human ACTH antibody or antibody fragment of Clause 34B, wherein detectable moiety comprises a fluorescent dye, enzyme, substrate, bioluminescent material, radioactive material, chemiluminescent moiety, or mixtures thereof.

Clause 36B. The anti-human ACTH antibody or antibody fragment of any one of Clauses 1B-35B, wherein the antibody or antibody fragment is attached to one or more functional moieties.

Clause 37B. An antibody produced against an anti-human ACTH antibody or anti-ACTH antibody fragment according to any one of Clauses 1B-36B.

Clause 38B. The antibody of Clause 37B, which is an anti-idiotypic antibody.

Clause 39B. A method of using an anti-idiotypic antibody or antibody fragment according to Clause 38B to detect the levels of said anti-ACTH antibody or antibody fragment and/or to neutralize said anti-ACTH antibody or antibody fragment in a subject administered said anti-ACTH antibody or antibody fragment.

Clause 40B. A composition suitable for therapeutic, prophylactic, or a diagnostic use comprising a therapeutically, prophylactically or diagnostically effective amount of at least one anti-human ACTH antibody or antibody fragment according to any one of Clauses 1B-39B.

Clause 41B. The composition of Clause 39B, which is suitable for subcutaneous administration.

Clause 42B. The composition of Clause 39B, which is suitable for intravenous administration.

Clause 43B. The composition of Clause 39B, which is lyophilized.

Clause 44B. The composition of any one of Clauses 39B-43B, further comprising a pharmaceutically acceptable diluent, carrier, solubilizer, emulsifier, preservative, or mixture thereof.

Clause 45B. The composition of any one of Clauses 39B-44B, further comprising another active agent.

Clause 46B. The composition of Clause 45B, wherein (i) the other active agent is selected from the group consisting of ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®) or wherein the other active agent is selected from the group consisting of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, anti-hypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), and Zestril (lisinopril), and/or (ii) the other active agent is selected from the group consisting of: corticosteroids, glucocorticoids, mineralocorticoids, cortisol (hydrocortisone), dexamethasone, cortisone, prednisone, prednisolone, methylprednisolone, dexamethasone, betamethasone, triamcinolone, beclometasone, fludrocortisone, fludrocortisone acetate, deoxycorticosterone, deoxycorticosterone acetate (DOCA), and aldosterone.

Clause 47B. The composition of any one of Clauses 39B-46B, which is lyophilized, stabilized and/or formulated for administration by injection.

Clause 48B. An isolated nucleic acid sequence or nucleic acid sequences encoding an anti-human ACTH antibody or antibody fragment or anti-idiotypic antibody or antibody fragment according to any one of Clauses 1B-37B.

Clause 49B. A vector or vectors containing the isolated nucleic acid sequence or sequences of Clause 48B.

Clause 50B. A host cell comprising the isolated nucleic acid sequence or sequences of Clause 46B or the vector or vectors of Clause 49B.

Clause 51B. The host cell of Clause 50B, which is a mammalian, bacterial, fungal, yeast, avian or insect cell.

Clause 52B. The host cell of Clause 51B, which is a filamentous fungi or a yeast.

Clause 53B. The host cell of Clause 52B, wherein the yeast is selected from the from the following genera: *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis;* and *Zygosaccharomyces.*

Clause 54B. The host cell of Clause 53B, which is the yeast genus is *Pichia.*

Clause 55B. The host cell of Clause 54B, wherein the species of *Pichia* is selected from *Pichia pastoris, Pichia methanolica* and *Hansenula polymorpha (Pichia angusta).*

Clause 56B. A method of making an anti-human ACTH antibody or antibody fragment comprising culturing the host cell of any one of Clauses 50B-55B under conditions that provide for expression of said antibody or antibody fragment.

Clause 57B. The method of Clause 56B, wherein the host cell is a polyploid yeast culture that stably expresses and secretes into the culture medium at least 10-25 mg/liter of said antibody or antibody fragment.

Clause 58B. The method of Clause 57B, wherein said polyploidal yeast is made by a method that comprises:
(i) introducing at least one expression vector containing one or more heterologous polynucleotides encoding said antibody operably linked to a promoter and a signal sequence into a haploid yeast cell;
(ii) producing by mating or spheroplast fusion a polyploidal yeast from said first and/or second haploid yeast cell;
(iii) selecting polyploidal yeast cells that stably express said antibody; and
(iv) producing stable polyploidal yeast cultures from said polyploidal yeast cells that stably express said antibody into the culture medium.

Clause 59B. The method of Clause 58B, wherein said yeast is of the genus *Pichia.*

Clause 60B. A method for blocking, inhibiting or neutralizing one or more biological effects associated with ACTH comprising administering to a subject in need thereof an effective amount of an anti-human adrenocorticotrophic hormone ("ACTH") antibody or antibody fragment.

Clause 61B. A method for treating or preventing a condition associated with elevated ACTH levels in a subject, comprising administering to a subject in need thereof an effective amount of an anti-human adrenocorticotrophic hormone ("ACTH") antibody or antibody fragment.

Clause 62B. A method for treating or preventing a condition associated with elevated cortisol, corticosterone and/or aldosterone levels in a subject, comprising administering to the subject in need thereof an effective amount of an anti-human adrenocorticotrophic hormone ("ACTH") antibody or antibody fragment.

Clause 63B. The method of any one of Clauses 60B-62B, wherein (i) the condition is selected from the group consisting of ACTH-driven hypercortisolism (Cushing's Disease and/or Cushing's Syndrome), obesity, diabetes, Parkinson's disease, sleep disorders including e.g., insomnia, sleep apnea, narcolepsy, depression, anxiety disorders, cancer (such as Cushing's Syndrome resulting from ectopic ACTH expression, e.g., in small cell lung cancer, non-small cell lung cancer (NSCLC), pancreatic carcinoma, neural tumors, or thymoma), muscle atrophies, hypertension, Alzheimer's disease, dementia and other cognitive dysfunction disorders, Alzheimer's disease, galactorrhea, stress related disorders, heart failure, diabetes, hyperinsulinemia, metabolic syndromes, hyperaldosteronism, Conn's syndrome and familial hyperaldosteronism, or (ii) wherein the condition comprises congenital adrenal hyperplasia (CAH), Classical CAH, or Nonclassical CAH, or (iii) wherein the condition comprises familial glucocorticoid deficiency (FGD) or (iv) wherein the condition comprises Allgrove syndrome, bilateral adrenalectomy, or Nelson's syndrome.

Clause 64B. A method for neutralizing ACTH-induced MCR signaling, comprising administering to a subject in need thereof an effective amount of an anti-human adrenocorticotrophic hormone ("ACTH") antibody or antibody fragment.

Clause 65B. A method for inhibiting ACTH-induced cortisol, corticosterone and/or aldosterone secretion, comprising administering to a subject in need thereof an effective amount of an anti-human adrenocorticotrophic hormone ("ACTH") antibody or antibody fragment.

Clause 66B. A method for reducing ACTH-induced plasma cortisol, corticosterone and/or aldosterone levels in a subject in need thereof, comprising administering to the subject in need thereof an effective amount of a human, humanized or chimerized anti-human adrenocorticotrophic hormone ("ACTH") antibody or antibody fragment.

Clause 67B. The method of any one of Clauses 60B-66B, wherein the antibody is a human, humanized or chimerized anti-ACTH antibody or antibody fragment Clause 68B. The method of any one of Clauses 60B-67B, wherein the antibody or antibody fragment substantially does not interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH ($ACTH_{1839}$).

Clause 69B. The method of any one of Clauses 60B-68B, wherein the at least one anti-human ACTH antibody or antibody fragment is selected from the group consisting of scFvs, camelbodies, nanobodies, IgNAR, Fab fragments, Fab' fragments, MetMab like antibodies, monovalent antibody fragments, and $F(ab')_2$ fragments.

Clause 70B. The method of any one of Clauses 60B-69B, wherein the at least one anti-human ACTH antibody or antibody fragment substantially or entirely lacks N-glycosylation and/or 0-glycosylation.

Clause 71B. The method of any one of Clauses 60B-70B, wherein the at least one anti-human ACTH antibody or antibody fragment comprises a human constant domain.

Clause 72B. The method of any one of Clauses 60B-71B, wherein the at least one anti-human ACTH antibody or antibody fragment is an IgG1, IgG2, IgG3, or IgG4 antibody.

Clause 73B. The method of any one of Clauses 60B-72B, wherein the at least one anti-human ACTH antibody or antibody fragment comprises an Fc region that has been modified to alter at least one of effector function, half-life, proteolysis, or glycosylation.

Clause 74B. The method of Clause 73B, wherein the Fc region contains one or more mutations that alters or eliminates N- and/or O-glycosylation.

Clause 75B. The method of any one of Clauses 60B-74B, wherein the at least one anti-human ACTH antibody or antibody fragment is a humanized antibody or antibody fragment.

Clause 76B. The method of any one of Clauses 60B-75B, wherein the at least one anti-human ACTH antibody or antibody fragment binds to ACTH with a $K_D$ of less than or equal to $5\times10^{-5}$ M, $10^{-5}$ M, $5\times10^{-6}$ M, $10^{-6}$ M, $5\times10^{-7}$ M, $10^{-7}$ M, $5\times10^{-8}$ M, $10^{-8}$ M, $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, or $10^{-13}$ M.

Clause 77B. The method of any one of Clauses 60B-76B, wherein the at least one anti-human ACTH antibody or antibody fragment binds to ACTH with a $K_D$ of less than or equal to $10^{-10}$ M, $5\times10^{-11}$ M, $10^{-11}$ M, $5\times10^{-12}$ M, or $10^{-12}$ M.

Clause 78B. The method of any one of Clauses 60B-77B, wherein the at least one anti-human ACTH antibody or antibody fragment binds to ACTH with an off-rate (kd) of less than or equal to $5\times10^{-4}$ s$^{-1}$, $10^{-4}$ s$^{-1}$, $5\times10^{5}$ s$^{-1}$, or $10^{-5}$ s$^{-1}$.

Clause 79B. The method of any one of Clauses 60B-78B, wherein the at least one anti-human ACTH antibody or antibody fragment is directly or indirectly attached to a therapeutic agent.

Clause 80B. The method of any one of Clauses 60B-79B, wherein the at least one anti-human ACTH antibody or antibody fragment is attached to one or more detectable moieties.

Clause 81B. The method of Clause 80B, wherein detectable moiety comprises a fluorescent dye, enzyme, substrate, bioluminescent material, radioactive material, chemiluminescent moiety, or mixtures thereof.

Clause 82B. The method of any one of Clauses 60B-81B, wherein the at least one anti-human ACTH antibody or antibody fragment is attached to one or more functional moieties.

Clause 83B. The method of any one of Clauses 60B-82B, wherein the at least one isolated anti-human ACTH antibody or antibody fragment reduces plasma cortisol, corticosterone and/or aldosterone levels.

Clause 84B. The method of any one of Clauses 60B-83B, wherein the method further comprises administering separately or co-administering another agent.

Clause 85B. The method of Clause 84B, or wherein the other agent is selected from the group consisting of (i) ketoconazole (Nizoral®), aminoglutethimide (Cytadren®), metyrapone (Metopirone®), mitotane (Lysodren®) etomidate (Amidate®), cyproheptadine (Periactin® or Peritol®), valproic acid (Depakote®), cabergoline (Dostinex®), pasireotide (Signifor®), rosiglitazone (Avandia®), conivaptan (Vaprisol®), tolvaptan (OPC-41061), lixivaptan (VPA-985), satavaptan (SR121463, planned trade name Aquilda®), mifepristone (Korlym®), armodafinil (Nuvigil®) and modafinil (Provigil®) or wherein the other active agent is selected from the group consisting of: Accupril (quinapril), Aceon (perindopril), Adalat, Adalat CC, Aldactone (spironolactone), aldosterone receptor blockers, alpha-adrenergic receptor blockers, alpha-glucosidase inhibitors, Altace (ramipril), Alteplase, aminoglutethimide (Cytadren®), amiodarone, angiotensin converting enzyme (ACE) Inhibitors, angiotensin II receptor antagonists, Angiotensin II receptor blockers (ARBs), antiarrhythmics, anti-cholesterol drugs, anti-clotting agents, antidiabetogenic drugs, antihypertensive agents, antiplatelet drugs, ApoA-1 mimics, aspirin, Atacand (candesartan), Avapro (irbesartan), beta blockers, beta-adrenergic receptor blockers, Betapace (sotalol), BiDil (hydralazine with isosorbide dinitrate), biguanides, blood thinners, Brevibloc (esmolol), Bumex (bumetanide), cabergoline (Dostinex®), Caduet (a combination of a statin cholesterol drug and amlodipine), Calan, Calan SR, Calcium channel blockers, Capoten (captopril), Cardene, Cardene SR (nicardipine), Cardizem, Cardizem CD, Cardizem SR, CETP inhibitors, conivaptan (Vaprisol®), Cordarone (amiodarone), Coreg (carvedilol), Covera-HS, Cozaar (losartan), cyproheptadine (Periactin® or Peritol®), Demadex (torsemide), digoxin, Dilacor XR, Dilatrate-SR, Diltia XT, Diovan (valsartan), dipeptidyl peptidase-4 inhibitors, diuretics, Dobutrex (dobutamine), drugs that suppress ACTH secretion, drugs that suppress cortisol secretion, dual angiotensin converting enzyme/neutral endopeptidase (ACE/NEP) inhibitors, endothelin antagonists, endothelin receptor blockers, Esidrix (hydrochlorothiazide), etomidate (Amidate®), Fragmin, gemfibrozil (Lopid, Gemcor), glucocorticoid receptor antagonists, heart failure drugs, Heparin, HMG-Co-A reductase inhibitors, holestyramine (Questran), IMDUR (isosorbide mononitrate), Inderal (propranolol), inhibitors of a Na-K-ATPase membrane pump, inhibitors of steroidogenesis, insulin therapies, Iso-Bid, Isonate, Isoptin, Isoptin SR, Isorbid (isosorbide dinitrate), Isordil, Isotrate, ketoconazole (Nizoral®), Lasix (furosemide), lixivaptan (VPA-985), Lopressor, Lotensin (benazepril), Lovenox, Mavik (trandolapril), meglitinides, metyrapone (Metopirone®), Micardis (telmisartan), mifepristone (Korlym®), mitotane (Lysodren®), Monopril (fosinopril), neutral endopeptidase (NEP) inhibitors, Normodyne, Norvasc (amlodipine), obesity-reducing agents, Omacor, pantethine, pasireotide (Signifor®), Plendil (felodipine), PPAR-gamma agonists, Primacor (milrinone), Prinivil, Procanbid (procainamide), Procardia, Procardia XL (nifedipine), renin inhibitors, Reteplase, rosiglitazone (Avandia®), satavaptan (SR121463, planned trade name Aquilda®), Sectral (acebutolol), somatostatin analogs, Sorbitrate (isosorbide dinitrate), statins, Streptokinase, Sular (nisoldipine), sulfonylurea, Tambocor (flecainide), Tenecteplase, Tenormin (atenolol), thiazolidinediones, Tiazac (diltiazem), Tissue plasminogen activator (TPA), tolvaptan (OPC-41061), Toprol-XL (metoprolol), Trandate (labetalol), Univasc (moexipril), Urokinase, valproic acid (Depakote®), vaptans, Vascor (bepridil), vasodilators, Vasodilators, vasopressin antagonists, Vasotec (enalapril), Verelan, Verelan PM (verapamil), warfarin (Coumadin), Zaroxolyn (metolazone), Zebeta (bisoprolol), and Zestril (lisinopril), and/or (ii) the other active agent is selected from the group consisting of: corticosteroids, glucocorticoids, mineralocorticoids, cortisol (hydrocortisone), dexamethasone, cortisone, prednisone, prednisolone, methylprednisolone, dexamethasone, betamethasone, triamcinolone, beclometasone, fludrocortisone, fludrocortisone acetate, deoxycorticosterone, deoxycorticosterone acetate (DOCA), and aldosterone.

Clause 86B. The method of Clause 84B or 85B, wherein the antibody or antibody fragment or the composition containing the antibody of antibody fragment and the at least one other agent are administered concurrently.

Clause 87B. The method of Clause 84B or 85B, wherein the antibody or antibody fragment is administered before or after the at least one other agent.

Clause 88B. The method of any one of Clauses 60B-87B, wherein the anti-ACTH antibody or antibody fragment is a human, humanized or chimerized anti-ACTH antibody or antibody fragment which substantially does not interact with (bind) a polypeptide consisting of: (i) the 13 N-terminal amino acid residues of ACTH ($ACTH_{1-13}$) and/or alpha-MSH, or (ii) the 22 C-terminal amino acid residues of ACTH ($ACTH_{18-39}$) (Corticotrophin-Like Intermediate peptide or "CLIP").

Clause 89B. The method of any one of Clauses 60B-87B, wherein the anti-ACTH antibody or antibody fragment is a human, humanized or chimerized anti-ACTH antibody or antibody fragment which binds to $ACTH_{1-39}$ with a binding affinity ($K_D$) at least 10-fold, 100-fold, 1000-fold or 10,000-fold stronger than the binding affinity of said antibody or antibody fragment to (i) $ACTH_{1-13}$ and/or alpha-MSH, and/or (ii) CLIP (i.e., a numerically lower $K_D$ for $ACTH_{1-39}$ than for $ACTH_{1-13}$ and/or alpha-MSH and/or CLIP by at least 10-fold, 100-fold, 1000-fold or 10,000-fold).

Clause 90B. The method of any one of Clauses 60B-87B, wherein the anti-ACTH antibody or antibody fragment is a human, humanized or chimerized anti-human ACTH antibody or antibody fragment which neutralizes or inhibits ACTH activation of MC2R.

Clause 91B. The method of any one of Clauses 60B-87B, wherein the anti-ACTH antibody or antibody fragment is a human, humanized or chimerized anti-human ACTH antibody or antibody fragment which neutralizes or inhibits ACTH activation of at least one of MC2R, MC3R and MC4R.

Clause 92B. The method of any one of Clauses 60B-87B, wherein the anti-ACTH antibody or antibody fragment is a human, humanized or chimerized anti-human ACTH antibody or antibody fragment, which neutralizes or inhibits ACTH activation of each of MC2R, MC3R and MC4R.

Clause 93B. The method of any one of Clauses 60B-87B, wherein the anti-ACTH antibody or antibody fragment is a human, humanized or chimerized anti-human ACTH antibody or antibody fragment, which inhibits ACTH-induced corticosterone secretion.

Clause 94B. The method of any one of Clauses 60B-87B, wherein the anti-ACTH antibody or antibody fragment is a human, humanized or chimerized anti-human ACTH antibody or antibody fragment, which when administered to a human subject reduces plasma cortisol, corticosterone and/or aldosterone levels.

Clause 95B. The method of any one of Clauses 60B-87B, wherein the anti-ACTH antibody or antibody fragment is a human, humanized or chimerized anti-human ACTH antibody or antibody fragment capable of inhibiting the binding of ACTH to a MCR.

Clause 96B. The method of any one of Clauses 60B-87B, wherein the anti-ACTH antibody or antibody fragment is a human, humanized or chimerized anti-human ACTH antibody or antibody fragment, capable of inhibiting the binding of ACTH to at least one of MC1R, MC2R, MC3R, MC4R and MC5R; at least one of MC2R, MC3R, and MC4R; each of MC2R, MC3R, and MC4R; or each of MC1R, MC2R, MC3R, MC4R and MC5R.

Clause 97B. The method of any one of Clauses 60B-83B, wherein the method further comprises one or more of supplemental oxygen, continuous positive airway pressure (CPAP), bilevel positive airway pressure (BPAP), expiratory positive airway pressure (EPAP), adaptive servo-ventilation (ASV), oral applicanes, uvulopalatopharyngoplasty (UPPP), maxillomandibular advancement, nasal surgery, and removal of tonsils and/or adenoids.

The entire disclosure of each document cited herein (including patents, patent applications, journal articles, abstracts, manuals, books, or other disclosures) including all references cited herein (including, without limitation thereto, in the Background, Detailed Description, and Examples) is hereby incorporated by reference in its entirety.

The following examples are put forth so as to provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight, temperature is in degrees centigrade; and pressure is at or near atmospheric.

EXAMPLES

Example 1 Preparation of Antibodies that Selectively Bind ACTH

By using an antibody selection protocol substantially as described herein, a panel of antibodies specific to ACTH was produced.

Immunization Strategy

Rabbits were immunized with ACTH 1-24 (Bachem, Torrance, Calif.) (SEQ ID NO: 1122) or ACTH 1-39 (Bachem) (SEQ ID NO:1121). Peptides were prepared for immunization as follows. A volume of 1 ml of 10 mg/ml KLH was dissolved in DPBS supplemented to 1M NaCl and combined with 0.5 ml of 5 mg/ml peptide (dissolved in deionized water). Then 1.4 ml of 40 mM Carbodiimide was added prior to a 12-hour incubation at room temperature with gentle mixing. Excess Carbodiimide and unconjugated peptide were removed by dialysis to DPBS prior to sterile filtration. Next unconjugated peptide equal to the calculated mass of KLH was added to make a final total protein concentration of 3.75 mg/ml.

Immunizations were performed by diluting 200 μg of antigen to 0.5 ml with DPBS and mixing with an equal volume of complete Freund's adjuvant for subcutaneous 1 ml injection at Day 1.

Boost injections of 100 ug were performed at Day 21, 42 and 60.

Antibody Selection Titer Assessment

To identify antibodies that neutralize ACTH 1-39 (SEQ ID NO:1121) induced signaling via MC2R, polyclonal antibody solutions were first purified via Protein A and dialyzed into a neutral buffer. Briefly, antibody solutions were incubated with ACTH 1-39 (SEQ ID NO:1121) at 3× the final concentration (100 pM) for 1 hr. While the antibody/antigen complexes were incubated, MC2R expressing cells (Life Technologies, Grand Island, N.Y.) were detached with 0.25% trypsin for 4 minutes. The cells were washed and re-suspended at $2 \times 10^6$ cells per ml in assay buffer (Meso Scale Discovery [MSD], Rockville, Md.) and treated with 0.2 mM IBMX (Sigma, St. Louis Mo.). Ten microliters of cells was combined with 20 μl of Ab/Ag mixture and added to a cAMP plate (MSD) and incubated for 30 minutes at room temperature with shaking. Next 20 μl of labeled cAMP in cell lysis buffer (MSD) was added and incubated for 1 hour while shaking. Following the incubation, 100 μl read buffer (MSD) was added and read with a Sector Imager 2400.

Tissue Harvesting

Once acceptable titers were established, the rabbit(s) were sacrificed. Spleen, lymph nodes, and whole blood were harvested and processed as follows:

Spleen and lymph nodes were processed into a single cell suspension by disassociating the tissue and pushing through sterile wire mesh at 70 μm (Fisher) with a plunger of a 20 cc syringe. Cells were collected in PBS. Cells were washed twice by centrifugation. After the last wash, cell density was determined by trypan blue. Cells were centrifuged at 1500 RPM for 10 minutes; the supernatant was discarded. Cells were resuspended in the appropriate volume of 10% dimethyl sulfoxide (DMSO, Sigma) in FBS (Hyclone) and dispensed at 1 ml/vial. Vials were stored at −70° C. in a slow freezing chamber for 24 hours and stored in liquid nitrogen.

Peripheral blood mononuclear cells (PBMCs) were isolated by mixing whole blood with equal parts of PBS. 35 ml of the whole blood mixture was carefully layered onto 8 ml of Lympholyte® Rabbit (Cedarlane, Burlington, Ontario, Canada) into a 45 ml conical tube (Corning) and centrifuged 30 minutes at 2500 RPM at room temperature without brakes. After centrifugation, the PBMC layers were carefully removed using a glass Pasteur pipette (VWR), combined, and placed into a clean 50 mL vial. Cells were washed twice with PBS by centrifugation at 1500 RPM for 10 minutes at room temperature, and cell density was determined by trypan blue staining. After the last wash, cells were resuspended in an appropriate volume of 10% DMSO/FBS medium and frozen as described above.

B Cell Selection, Enrichment and Culture Conditions

On the day of setting up B cell culture, PBMC, splenocyte, or lymph node vials were thawed for use. Vials were removed from LN2 tank and placed in a 37° C. water bath until thawed. Contents of vials were transferred into 15 mL conical centrifuge tube (Corning) and 10 mL of modified RPMI was slowly added to the tube. Cells were centrifuged for 5 minutes at 2K RPM, and the supernatant was discarded. Cells were resuspended in 10 mL of fresh media. Cell density and viability was determined by trypan blue.

For positive selection of anti-ACTH producing B-cells, biotinylated human ACTH 1-39 (SEQ ID NO:1121) was pre-loaded onto the streptavidin beads as follows. Seventy-five microliters of streptavidin beads (Miltenyi Biotec, Auburn Calif.) were mixed with N-terminally biotinylated human ACTH 1-39 (1 g/mL final concentration) and 300 μl of PBS supplemented with 0.5% biotin free BSA and 2 mM EDTA (PBF). This mixture was incubated at 4° C. for 30 minutes and unbound biotinylated human ACTH 1-39 (Bachem) was removed using a MACS® separation column (Miltenyi Biotec) with a 1 ml rinse to remove unbound material. Then bound material was plunged out by detachment from the magnet and used to resuspend cells from above in 100 μL per 1×10$^7$ cells. The mixture was then incubated at 4° C. for 30 minutes and washed once with 10 mL of PBF. After washing, the cells were resuspended in 500 μL of PBF and set aside. A MACS® MS column (Miltenyi Biotec) was pre-rinsed with 500 μL of PBF on a magnetic stand (Miltenyi Biotec). Cell suspension was applied to the column through a pre-filter, and unbound fraction was collected. The column was washed with 2.5 mL of PBF buffer. The column was removed from the magnet stand and placed onto a clean, sterile 1.5 mL Eppendorf tube. 1 mL of PBF buffer was added to the top of the column, and positive selected cells were collected. The yield and viability of positive cell fraction was determined by trypan blue staining. Positive selection yielded an average of 1% of the starting cell concentration.

A pilot cell screen was established to provide information on seeding levels for the culture. Plates were seeded at 5, 10, 25, 50, 100, or 200 enriched B cells/well. In addition, each well contained 25-50K cells/well of irradiated EL-4.B5 cells (5,000 Rads) and an appropriate level of activated rabbit T cell supernatant (See U.S. Patent Application Publication No. 20070269868) (ranging from 1-5% depending on preparation) in high glucose modified RPMI medium at a final volume of 250 μL/well. Cultures were incubated for 5 to 7 days at 37° C. in 4% $CO_2$.

B-Cell Culture Screening by Antigen-Recognition (ELISA)

To identify wells producing anti-human ACTH antibodies, B-cell supernatants were tested by antigen-recognition (ELISA). Briefly, neutravidin coated plates (Thermo Scientific), were coated with N-term biotinylated human ACTH 1-39 (Bachem) (50 μl per well; 1 μg/ml) diluted in ELISA buffer (0.5% fish skin gelatin in PBS pH 7.4) either for approximately 1 hour at room temperature or alternatively overnight at 4° C. The plates were then further blocked with ELISA buffer for one hour at room temperature and washed using wash buffer (PBS, 0.05% Tween 20). B-cell supernatant samples (50 μL) were transferred onto the wells and incubated for one hour at room temperature. After this incubation, the plate was washed with wash buffer. For development, an anti-rabbit specific Fc-HRP (1:5000 dilution in ELISA buffer) was added onto the wells and incubated for 45 minutes at room temperature. After a 3× wash step with wash solution, the plate was developed using TMB substrate for two minutes at room temperature and the reaction was quenched using 0.5M HCl. The well absorbance was read at 450 nm.

To identify wells producing anti-human ACTH antibodies that do not recognize ACTH 1-13 (SEQ ID NO: 1123) or ACTH 18-39 (SEQ ID NO: 1124), supernatant from wells positive for ACTH 1-39 binding by ELISA were tested by ELISA for binding to ACTH 1-13 and ACTH 18-39. Briefly, a mixture of biotinylated ACTH 1-13 (SEQ ID NO:1121) and ACTH 18-39 (SEQ ID NO:1124) was bound onto Neutravidin coated plates (50 g per well, 1 μg/l each peptide). B-cell supernatant samples (50 μl) were tested without prior dilution. Recognition in this assay indicates cross reactivity with sub-peptide products of ACTH.

Identification of Functional Activity in B-Cell Supernatants Using One or More Assays To identify wells producing anti-human ACTH antibodies that block signaling of ACTH via MC2R, supernatant from positive wells for ACTH 1-39 binding by ELISA were tested in the cAMP assay (MSD) with MC2R expressing cells (Life Technologies). Supernatants (76 μl) were pre-incubated with 4 μl of a solution containing 3 nM ACTH 1-39 (Bachem) for 1 hour at room temperature. During the incubation, MC2R cells were prepared as described for titer assessment. Cells (10 μl) and antigen/antibody complex (20 μl) were incubated together in a cAMP assay plate (MSD) and incubated at room temperature for 30 minutes while shaking. Following the incubation, 20 μl of labeled cAMP in lysis buffer (MSD) was added and the plate was incubated for 1 hour while shaking. After the final incubation, 100 μl of 1.5× read buffer (MSD) was added and plates read with a SECTOR® Imager 2400.

Alternatively, the supernatants were tested in a similar assay to determine the ability to block signaling of ACTH in MC2R expressing cells via cAMP accumulation with a cAMP HTRF assay (Cisbio). Supernatants (78 μl) were pre-incubated 2 μl 5 nM ACTH 1-39 (Bachem) for 1 hour at 37 C. During the incubation, MC2R cells were prepared as described for titer assessment. Cells (10 µl) and antigen/antibody complex (40 µl) were transferred to an HTRF plate and shaken at room temperature for 30 minutes. Following the incubation, 20 µl of (1:20 diluted) Eu3+ cryptate-labeled MAb anti-cAMP and 20 µl of (1:20 diluted) d2-labeled cAMP was added and the plate was incubated for 1 hour while shaking. Following incubation plates were read (excitation 330, emission 620/665 nM) and a ratio of 620:665 signal was determined.

Isolation of Antigen-Specific B Cells

Antigen-specific B cells were isolated (for general methods see co-owned publication no. WO/2014/146074, which is hereby incorporated by reference in its entirety). Plates containing wells of interest were removed from −70° C., and the cells from each well were recovered using five washes of 200 microliters of medium (10% RPMI complete, 55 µM BME) per well. The recovered cells were pelleted by centrifugation and the supernatant was carefully removed. Cells from each well were then re-suspended in 100 µl of medium and transferred to a 96 well plate. Cells were incubated for 90 minutes at 37° C. Following incubation, cells were pelleted by centrifugation, stained with a FITC-labeled anti-rabbit IgG (final concentration 6.25 µg/ml) (Creative Diagnostics, Shirley, N.Y.) and washed with up to 2 milliliters FACS buffer (Dulbecco's PBS w/ 2% FBS) and re-suspended in 250 ul of FACS buffer.

Control wells from the same culture sets that were similar in composition to pooled wells of interest were thawed and stained along side target wells. These samples were initially run on FACS (BD Influx) and gates were established for IgG, viability and physical parameters (FSC/SSC) that differentiate B cells from the murine EL4 cells. Once gates were established, the sample of interest was run and IgG positive, viable cells that are of a consistent physical (FSC/SSC) population were sorted individually into wells of a 96 well plate pre-loaded with RT-PCR master mix. Upwards of 8 cells per well were sorted. Sorted plates were removed from the sorter and transferred directly to thermocyclers for PCR.

Amplification and Sequence Determination of Antibody Sequences from FACS-Sorted B Cells Antibody sequences were recovered using a combined RT-PCR based method from a single cell sorted B-cell. Primers containing restriction enzymes were designed to anneal in conserved and constant regions of the target immunoglobulin genes (heavy and light), such as rabbit immunoglobulin sequences, and a two-step nested PCR recovery was used to amplify the antibody sequence. Amplicons from each well were sequenced and analyzed. Representative antibodies from the resulting sequence clusters are selected for recombinant protein expression. The original heavy and light variable regions amplified from rabbit cells are cloned into human heavy and light chain constant region expression vectors via restriction enzyme digestion and ligation. Vectors containing subcloned DNA fragments were amplified and purified. The sequences of the subcloned heavy and light chains were verified prior to expression.

Recombinant Production of Monoclonal Antibody of Desired Antigen Specificity and/or Functional Properties To determine antigen specificity and functional properties of recovered antibodies from specific B-cells, the heavy and light chain plasmids were co-transfected to generate rabbit/human chimeric antibodies for testing. Briefly, heavy and light chimeric plasmids were transiently transfected into HEK-293 cells. Transfections were allowed to incubate for 5-7 days and upon harvest cells were pelleted by centrifugation. Supernatants were submitted for purification via Protein A. Resulting purified chimeric antibodies were then evaluated in a variety of assays to confirm specificity and potency.

Antigen-Recognition of Recombinant Antibodies by ELISA

To characterize recombinant expressed antibodies for their ability to bind to human ACTH 1-39 antibody-containing solutions were tested by ELISA. All incubations were done at room temperature. Briefly, N-term biotinylated human ACTH 1-39 was bound onto Neutravidin coated plates (Thermo Scientific) (50 µl per well, 1 µg/mL) in PBS) for 2 hours. ACTH-coated plates were then washed three times in wash buffer (PBS, 0.05% Tween-20). The plates were then blocked using a blocking solution (PBS, 0.5% fish skin gelatin, 0.05% Tween-20) for approximately one hour. The blocking solution was then removed and the plates were then incubated with a dilution series of the antibody being tested for approximately one hour. At the end of this incubation, the plate was washed three times with wash buffer and further incubated with a secondary antibody containing solution (Peroxidase conjugated AffiniPure™ F(ab')$_2$ fragment goat anti-human IgG, Fc fragment specific (Jackson Immunoresearch) for approximately 45 minutes and washed three times. Next a substrate solution (TMB peroxidase substrate, BioFx®, SurModics, Eden Prairie, Minn.) was added and incubated for 3 to 5 minutes in the dark. The reaction was stopped by addition of 0.5M HCl and the plate was read at 450 nm in a plate-reader.

Alternatively, To characterize recombinant expressed antibodies for their ability to preferentially bind ACTH 1-39 and not ACTH 1-13 or ACTH 18-39 (respectively containing the amino acids contained in alpha-MSH and CLIP), a competition HTRF ELISA was performed. In parallel, 10 µl of an antibody dilution series (highest final concentration of 100 nM) were incubated with 10 µl of N-term biotinylated human ACTH 1-39 (67 nM final) alone or in combination with either (i) ACTH 1-13 (55 nM final) and ACTH 18-39 (55 nM final), or (ii) ACTH 1-13 (550 nM final) and ACTH 18-39 (550 nM final) in a HTRF plate. Twenty microliters of Eu3+ cryptate labeled anti-hu Fc donor and 20 µl of d2-labeled streptavidin acceptor were added to each well and incubated for 1 hour at room temperature. Fluorescence was measured at 620 and 665 nM with a delay of 300 µsec.

Results

Using the above-described methods, numerous functional (antagonistic) antibodies that bind intact human ACTH, but which do not, or do not appreciably bind to alpha-MSH or CLIP were identified. Polypeptide and exemplary coding sequences of these antibodies are contained in the included biological sequence listing. Additionally, sequences for Ab13, Ab15, and Ab17 are shown in the included FIGS. 1-4. The full-length antibodies Ab13, Ab15, and Ab17 used in these examples were expressed as the heavy chain polypeptides having the sequences of SEQ ID NOs: 1, 41, and 81, respectively, and the light chain polypeptides of SEQ ID NOs: 21, 61, and 101, respectively. The heavy chain polypeptides of antibodies Ab13, Ab15, and Ab17 were expressed from the polynucleotides of SEQ ID NOs: 11, 51, and 91, respectively. The light chain polypeptides of antibodies Ab13, Ab15, and Ab17 were expressed from the polynucleotides of SEQ ID NOs: 31, 71, and 111, respectively.

The full-length antibodies Ab1, Ab2, Ab3, Ab4, Ab5, Ab6, Ab7, Ab9, Ab10, Ab11, and Ab12 used in these examples were expressed as the heavy chain polypeptides having the sequences of SEQ ID NOs: 681, 721, 761, 801, 841, 881, 921, 961, 1001, 1041, and 1081, respectively, and the light chain polypeptides of SEQ ID NOs: 701, 741, 781, 821, 861, 901, 941, 981, 1021, 1061, and 1101, respectively. The heavy chain polypeptides of antibodies Ab1, Ab2, Ab3, Ab4, Ab5, Ab6, Ab7, Ab9, Ab10, Ab11, and Ab12 were expressed from the polynucleotides of SEQ ID NOs: 691, 731, 771, 811, 851, 891, 931, 971, 1011, 1051, and 1091, respectively. The light chain polypeptides of antibodies Ab1, Ab2, Ab3, Ab4, Ab5, Ab6, Ab7, Ab9, Ab10, Ab11, and Ab12 were expressed from the polynucleotides of SEQ ID NOs: 711, 751, 791, 831, 871, 911, 951, 991, 1031, 1071, and 1111, respectively. Additional features of said antibodies are identified by SEQ ID NOs in FIGS. 5-12.

The binding and functional properties of exemplary anti-ACTH antibodies produced according to the invention are further described below.

FIG. 13 are representative of binding curves for the identified anti-ACTH antibodies for human ACTH (showing results for Ab1). EC50 values were computed for each antibody based upon their binding curves and are shown in Table 1 below. The results demonstrate that Ab1-Ab7, Ab9-Ab13, Ab15, and Ab17 bind to and recognize human ACTH with high affinity, ranging between EC50 values of 0.24 nM and 2.24 nM.

TABLE 1

Binding (EC50) of anti-ACTH antibodies for human ACTH.

| ANTIBODY | huACTH 1-39 $EC_{50}$ nM |
|---|---|
| Ab1 | 0.48 |
| Ab2 | 0.42 |
| Ab3 | 0.24 |
| Ab4 | 0.39 |
| Ab5 | 1.50 |
| Ab6 | 2.00 |
| Ab7 | 2.24 |
| Ab9 | 2.05 |
| Ab10 | 1.57 |
| Ab11 | 0.81 |
| Ab12 | 0.76 |
| Ab13 | 1.04 |
| Ab15 | 0.90 |
| Ab17 | 0.81 |

Additionally, anti-human ACTH antibodies that do not recognize ACTH 1-13 (SEQ ID NO:1122) or ACTH 18-39 (SEQ ID NO:1124) were identified by ELISA. Briefly, neutravidin plates (Thermo Scientific) were coated with a mixture of biotinylated ACTH 1-13 and ACTH 18-39 (50 µl per well, 1 µg/ml each peptide) and the ELISA assay run as described above.

Results: FIG. 14 shows representative binding curves for an anti-ACTH antibody (specifically, Ab1) for ACTH 1-13 or ACTH 18-39. Based upon these results, the EC50 was determined to be >10 µM in all instances, as shown in Table 2, indicating at most relatively low specific binding (or no specific binding).

TABLE 2

Binding (EC50) of anti-ACTH antibodies for human ACTH 1-13 and human ACTH 18-39.

| ANTIBODY | huACTH 1-13 $EC_{50}$ | huACTH 18-39 $EC_{50}$ |
|---|---|---|
| Ab1 | >10 µM | >10 µM |
| Ab2 | >10 µM | >10 µM |

TABLE 2-continued

Binding (EC50) of anti-ACTH antibodies for human ACTH 1-13 and human ACTH 18-39.

| ANTIBODY | huACTH 1-13 $EC_{50}$ | huACTH 18-39 $EC_{50}$ |
|---|---|---|
| Ab3 | >10 µM | >10 µM |
| Ab4 | >10 µM | >10 µM |
| Ab5 | >10 µM | >10 µM |
| Ab6 | >10 µM | >10 µM |
| Ab7 | >10 µM | >10 µM |
| Ab9 | >10 µM | >10 µM |
| Ab10 | >10 µM | >10 µM |
| Ab11 | >10 µM | >10 µM |
| Ab12 | >10 µM | >10 µM |
| Ab13 | >10 µM | >10 µM |
| Ab15 | >10 µM | >10 µM |
| Ab17 | >10 µM | >10 µM |

Alternatively, to identify antibodies that preferentially bind ACTH 1-39 (SEQ ID NO:1121) and not ACTH 1-13 (SEQ ID NO:1123) or ACTH 18-39 (SEQ ID NO:1124) sub-peptides of full length ACTH (i.e., corresponding to the amino acids contained in alpha-MSH and CLIP, respectively), a competition HTRF ELISA was performed.

In parallel, 10 µl of an antibody dilution series (highest final concentration of 100 nM) were incubated with 10 µl of N-term biotinylated human ACTH 1-39 (67 nM final) alone or in combination with either (i) ACTH 1-13 (55 nM final) and ACTH 18-39 (55 nM final), or (ii) ACTH 1-13 (550 nM final) and ACTH 18-39 (550 nM final) in a HTRF plate. Twenty microliters of Eu3+ cryptate labeled anti-hu Fc donor and 20 µl of d2-labeled streptavidin acceptor were added to each well and incubated for 1 hour at room temperature. Fluorescence was measured at 620 and 665 nM with a delay of 300 µsec.

Results

FIG. 15 and FIG. 45 provide representative binding data for the subject anti-human ACTH antibodies to ACTH 1-39 and the inability of human ACTH 1-13 and ACTH 18-39 to compete with binding of ACTH 1-39 (specifically, for Ab5 and Ab13, respectively). Similar lack of effects of human ACTH 1-13 and ACTH 18-39 on binding to ACTH 1-39 were observed for Ab6-Ab7, Ab9-Ab13, Ab15, and Ab17 (not shown). The lack of effect of ACTH 1-13 and ACTH 18-39 on binding to ACTH 1-39 is also reflected in the EC50 values of >10 µM for these fragments indicated in Table 2 above. These results demonstrate that Ab5-Ab7, Ab9-Ab13, Ab15, and Ab17 bind to ACTH 1-39 but do not bind (or do not appreciably bind) ACTH 1-13 or ACTH 18-39.

Humanized forms of antibodies Ab1, Ab2, Ab3, Ab4, Ab6, Ab7, Ab10, Ab11, Ab12, Ab13, Ab15, and Ab17 were produced and are identified by an appended ".H", i.e., Ab1.H, Ab2.H, Ab3.H, Ab4.H, Ab6.H, Ab7.H, Ab10.H, Ab11.H, Ab12.H, Ab13.H, Ab15.H, and Ab17.H. Further variants of the humanized Ab7.H and Ab11.H sequences were also produced and are identified as Ab7A.H and Ab11A.H, respectively.

Functional Characterization of Antibodies by cAMP Assay

The ability of anti-ACTH antibodies to neutralize ACTH-induced MC2R signaling was tested in a cell-based assay.

For Ab1-Ab4, to identify antibodies that neutralize ACTH-induced signaling via MC2R, antibody solutions were incubated with ACTH 1-39 at 3× the final concentration (100 pM) for 1 hour. While the antibody/antigen complexes were incubated, MC2R cells were detached with 0.25% trypsin for 4 minutes. The cells were washed and re-suspended at 2×10⁶ cells per ml in assay buffer (MSD) and treated with 0.2 mM IBMX. Ten microliters of cells was combined with 20 μl of antigen/antibody mixture and added to a cAMP plate (MSD) and incubated for 30 minutes at room temperature while shaking. After the incubation, 20 μl of labeled cAMP in cell lysis buffer (MSD) was added and incubated 1 hour while shaking. Following last incubation 100 μl of 1.5×MSD read buffer was added and read with Sector Imager 2400.

Results: FIG. 16 shows an inhibition curve (for Ab1) that is representative of the inhibition curves obtained with the other tested antibodies. The inhibition results were quantified for each antibody to yield an IC50 value, which are summarized in Table 3 below. These results demonstrated that anti-ACTH 1-39 antibodies Ab1-Ab4 inhibited ACTH induced cAMP in cells expressing MC2R.

TABLE 3

Inhibition (IC50) of ACTH induced cAMP in cells expressing MC2R by anti-ACTH antibodies.

| ANTIBODY | MC2R IC$_{50}$ nM |
|---|---|
| Ab1 | 0.14 |
| Ab2 | 0.25 |
| Ab3 | 0.29 |
| Ab4 | 0.46 |
| Ab5 | 0.11 |
| Ab6 | 0.03 |
| Ab7 | 0.09 |
| Ab9 | 0.12 |
| Ab10 | 0.16 |
| Ab11 | 0.03 |
| Ab12 | 0.05 |
| Ab13 | 0.20 |
| Ab15 | 0.14 |
| Ab17 | 0.48 |
| Ab1.H | 0.01 |
| Ab2.H | 0.05 |
| Ab3.H | 0.15 |
| Ab4.H | 0.03 |
| Ab6.H | 0.06 |
| Ab7.H | 0.11 |
| Ab7A.H | 0.09 |
| Ab10.H | 0.01 |
| Ab11.H | 0.02 |
| Ab11A.H | 0.08 |
| Ab12.H | 0.05 |
| Ab13.H | 0.10 |
| Ab15.H | 0.60 |
| Ab17.H | 0.37 |

Alternatively, for Ab5-Ab7 and Ab9-Ab13, Ab15, Ab17, Ab1.H-Ab7.H, Ab7A.H, Ab10.H-Ab13.H, Ab11A.H, Ab15.H, and Ab17.H, to identify antibodies that neutralize ACTH 1-39 induced signaling via MC2R, antibody solutions were incubated with ACTH (1-39) at 4× the final concentration (100 pM) for 1 hr. While the antibody/antigen complexes were incubated for 1 hour, MC2R cells (Life Technologies) were detached with 0.25% trypsin for 4 minutes. The cells were washed and re-suspended at 1×10⁶ cells per ml culture media. Twenty microliters of Ab/antigen mixture was mixed with 20 μl of cells in HTRF plates and incubated with shaking for 30 minutes. Twenty microliters of Eu3+ cryptate labeled anti-cAMP MAb and 20 μl d2-labeled cAMP was added to each well and incubated for 1 hour with shaking. Fluorescence was measured at 620 and 665 nM with a delay of 300 μsec.

Results

FIG. 17 and FIG. 46 are representative of the inhibition curves obtained by this method (results are shown for Ab5 and Ab13, respectively). The computed IC50 values for each antibody (shown in Table 3 above) demonstrate that Ab5-Ab7, Ab9-Ab3, Ab15, Ab17, Ab1.H-Ab7.H, Ab7A.H, Ab10.H-Ab13.H, Ab11A.H, Ab15.H, and Ab17.H inhibited ACTH-induced cAMP in cells expressing MC2R.

Example 2 Binding Affinities of Anti-ACTH Antibodies

Binding affinities of monoclonal antibodies for human and mouse ACTH were estimated using Surface Plasmon Resonance (SPR) on the ProteOn™ XPR36 (Bio-Rad, Hercules, Calif.). Antibody was immobilized to the surface of general amine coupling (GLC or GLM) Chips (Bio-Rad). A dilution series of human ACTH 1-39 (SEQ ID NO: 1121) prepared in 1×HBS-EP+Buffer (10 mM Hepes; 150 mM NaCl; 3 mM EDTA, 0.05% Polysorbate 20; pH 7.6 at 25° C.) purchased from Thermo Scientific and supplemented with 0.2 mg/mL Bovine Serum Albumin (BSA) from Jackson ImmunoResearch and 0.005% sodium azide from VWR was used to query the antibodies. At the chosen concentrations of antigen (ranging from 454 ng/ml to 5.6 ng/ml) association times of 200 seconds and dissociation times of 30-200 minutes were used with the ProteOn™ Manager Software (v3.1.0.6, Bio-Rad) to group and fit data using a 1:1 Langmuir binding model. Surfaces were regenerated between analyte queries using 10 mM glycine at pH 2.0. Data repeated across a single density was averaged and a single $K_D$ and standard propagation of error calculated for each antibody.

The same procedure was used to determine binding affinities of antibodies for human alpha-MSH (ACTH 1-13) (SEQ ID NO:1123) and CLIP (ACTH 18-39) (SEQ ID NO:1124) except peptide concentrations ranged from 1.66 μg/ml to 0.02 μg/ml and 2.46 μg/ml to 0.03 μg/ml respectively with an association time of 200 seconds and dissociation times of 1-10 minutes.

The measured antibody affinities for ACTH are listed in Table 4.

TABLE 4

| Antibody | Ka (1/Ms) | Kd (1/s) | $K_D$ (M) |
|---|---|---|---|
| Ab1 | $1.0 \times 10^6$ | $1.9 \times 10^{-4}$ | $1.9 \times 10^{-10}$ |
| Ab2 | $1.0 \times 10^6$ | $1.3 \times 10^{-4}$ | $1.3 \times 10^{-10}$ |
| Ab3 | $8.2 \times 10^5$ | $1.5 \times 10^{-5}$ | $1.8 \times 10^{-11}$ |
| Ab4 | $1.0 \times 10^6$ | $2.7 \times 10^{-4}$ | $2.7 \times 10^{-10}$ |
| Ab5 | $1.0 \times 10^6$ | $6.4 \times 10^{-5}$ | $6.4 \times 10^{-11}$ |
| Ab6 | $1.0 \times 10^6$ | $1.9 \times 10^{-5}$ | $1.9 \times 10^{-11}$ |
| Ab7 | $1.0 \times 10^6$ | $3.7 \times 10^{-5}$ | $3.7 \times 10^{-11}$ |
| Ab9 | $9.1 \times 10^5$ | $4.7 \times 10^{-5}$ | $5.2 \times 10^{-11}$ |
| Ab10 | $1.0 \times 10^6$ | $1.1 \times 10^{-4}$ | $1.1 \times 10^{-10}$ |
| Ab11 | $1.0 \times 10^6$ | $4.0 \times 10^{-5}$ | $4.0 \times 10^{-11}$ |
| Ab12 | $8.2 \times 10^5$ | $9.8 \times 10^{-5}$ | $1.2 \times 10^{-10}$ |
| Ab13 | $1.0 \times 10^6$ | $8.3 \times 10^{-5}$ | $8.3 \times 10^{-11}$ |
| Ab15 | $8.3 \times 10^5$ | $7.2 \times 10^{-5}$ | $8.8 \times 10^{-11}$ |
| Ab17 | $7.6 \times 10^5$ | $2.5 \times 10^{-4}$ | $3.3 \times 10^{-10}$ |
| Ab1.H | $8.0 \times 10^5$ | $5.1 \times 10^{-5}$ | $6.3 \times 10^{-11}$ |
| Ab2.H | $8.9 \times 10^5$ | $1.6 \times 10^{-4}$ | $1.8 \times 10^{-10}$ |
| Ab3.H | $9.4 \times 10^5$ | $1.6 \times 10^{-5}$ | $1.7 \times 10^{-11}$ |
| Ab4.H | $1.0 \times 10^6$ | $1.3 \times 10^{-4}$ | $1.3 \times 10^{-10}$ |
| Ab6.H | $8.9 \times 10^5$ | $2.6 \times 10^{-5}$ | $2.9 \times 10^{-11}$ |
| Ab7.H | $1.0 \times 10^6$ | $5.2 \times 10^{-5}$ | $5.2 \times 10^{-11}$ |
| Ab7A.H | $1.0 \times 10^6$ | $6.0 \times 10^{-5}$ | $6.0 \times 10^{-11}$ |
| Ab10.H | $1.0 \times 10^6$ | $1.7 \times 10^{-5}$ | $1.7 \times 10^{-11}$ |
| Ab11.H | $6.4 \times 10^5$ | $1.4 \times 10^{-5}$ | $2.2 \times 10^{-11}$ |

TABLE 4-continued

| Antibody | Ka (1/Ms) | Kd (1/s) | $K_D$ (M) |
|---|---|---|---|
| Ab11A.H | $7.4 \times 10^5$ | $6.0 \times 10^{-5}$ | $8.2 \times 10^{-11}$ |
| Ab12.H | $3.7 \times 10^5$ | $5.6 \times 10^{-5}$ | $1.5 \times 10^{-10}$ |
| Ab13.H | $9.0 \times 10^5$ | $6.8 \times 10^{-5}$ | $7.6 \times 10^{-11}$ |
| Ab15.H | $1.0 \times 10^6$ | $1.6 \times 10^{-4}$ | $1.6 \times 10^{-10}$ |
| Ab17.H | $8.2 \times 10^5$ | $1.4 \times 10^{-5}$ | $1.7 \times 10^{-10}$ |

Examples of antibody affinities for CLIP are listed in Table 5.

TABLE 5

| Antibody | Ka (1/Ms) | Kd (1/s) | $K_D$ (M) |
|---|---|---|---|
| Ab1 | $6.2 \times 10^5$ | $9.2 \times 10^{-2}$ | $1.5 \times 10^{-7}$ |
| Ab2 | $8.4 \times 10^5$ | $2.6 \times 10^{-2}$ | $3.1 \times 10^{-8}$ |
| Ab3 | $3.4 \times 10^5$ | $8.5 \times 10^{-3}$ | $2.5 \times 10^{-8}$ |
| Ab4 | $7.1 \times 10^5$ | $1.9 \times 10^{-1}$ | $2.7 \times 10^{-7}$ |
| Ab5 | $<1.0 \times 10^0$ | $>1.0 \times 10^{-1}$ | $>1.0 \times 10^{-1}$ |
| Ab6 | $<1.0 \times 10^0$ | $>1.0 \times 10^{-1}$ | $>1.0 \times 10^{-1}$ |
| Ab7 | $<1.0 \times 10^0$ | $>1.0 \times 10^{-1}$ | $>1.0 \times 10^{-1}$ |
| Ab9 | $<1.0 \times 10^0$ | $>1.0 \times 10^{-1}$ | $>1.0 \times 10^{-1}$ |
| Ab10 | $1.1 \times 10^6$ | $2.7 \times 10^{-1}$ | $2.5 \times 10^{-7}$ |
| Ab11 | $1.6 \times 10^6$ | $8.6 \times 10^{-2}$ | $5.4 \times 10^{-8}$ |
| Ab12 | $8.9 \times 10^5$ | $2.4 \times 10^{-2}$ | $2.7 \times 10^{-8}$ |
| Ab13 | $9.8 \times 10^5$ | $8.5 \times 10^{-3}$ | $8.6 \times 10^{-9}$ |
| Ab15 | $6.3 \times 10^5$ | $3.1 \times 10^{-2}$ | $5.0 \times 10-8$ |
| Ab17 | $5.1 \times 10^5$ | $3.1 \times 10^{-3}$ | $6.1 \times 10^{-9}$ |
| Ab1.H | $5.8 \times 10^5$ | $1.2 \times 10^{-2}$ | $2.0 \times 10^{-8}$ |
| Ab2.H | $6.0 \times 10^5$ | $1.7 \times 10^{-2}$ | $2.8 \times 10^{-8}$ |
| Ab3.H | $3.2 \times 10^5$ | $5.3 \times 10^{-3}$ | $1.6 \times 10^{-8}$ |
| Ab4.H | $2.5 \times 10^5$ | $2.3 \times 10^{-2}$ | $9.2 \times 10^{-8}$ |
| Ab6.H | $<1.0 \times 10^0$ | $>1.0 \times 10^{-1}$ | $>1.0 \times 10^{-1}$ |
| Ab7.H | $<1.0 \times 10^0$ | $>1.0 \times 10^{-1}$ | $>1.0 \times 10^{-1}$ |
| Ab7A.H | $<1.0 \times 10^0$ | $>1.0 \times 10^{-1}$ | $>1.0 \times 10^{-1}$ |
| Ab10.H | $5.4 \times 10^5$ | $7.0 \times 10^{-3}$ | $1.3 \times 10^{-8}$ |
| Ab11.H | $5.4 \times 10^5$ | $1.1 \times 10^{-2}$ | $2.0 \times 10^{-8}$ |
| Ab11A.H | $7.0 \times 10^5$ | $1.4 \times 10^{-2}$ | $2.0 \times 10^{-8}$ |
| Ab12.H | $5.8 \times 10^5$ | $5.1 \times 10^{-3}$ | $8.8 \times 10^{-9}$ |
| Ab13.H | $5.0 \times 10^5$ | $7.0 \times 10^{-3}$ | $1.4 \times 10^{-8}$ |
| Ab15.H | $4.2 \times 10^5$ | $9.3 \times 10^{-2}$ | $2.2 \times 10^{-7}$ |
| Ab17.H | $6.6 \times 10^5$ | $8.7 \times 10^{-3}$ | $1.3 \times 10^{-8}$ |

Examples of antibody affinities for alpha-MSH are listed in Table 6.

TABLE 6

| Antibody | Ka (1/Ms) | Kd (1/s) | $K_D$ (M) |
|---|---|---|---|
| Ab1 | $<1.0 \times 10^0$ | $>1.0 \times 10^{-1}$ | $>1.0 \times 10^{-1}$ |
| Ab2 | $<1.0 \times 10^0$ | $>1.0 \times 10^{-1}$ | $>1.0 \times 10^{-1}$ |
| Ab3 | $<1.0 \times 10^0$ | $>1.0 \times 10^{-1}$ | $>1.0 \times 10^{-1}$ |
| Ab4 | $<1.0 \times 10^0$ | $>1.0 \times 10^{-1}$ | $>1.0 \times 10^{-1}$ |
| Ab5 | $2.6 \times 10^5$ | $1.4 \times 10^{-2}$ | $5 5 \times 10^{-8}$ |
| Ab6 | $3.3 \times 10^5$ | $5.2 \times 10^{-3}$ | $1.6 \times 10^{-8}$ |
| Ab7 | $1.3 \times 10^5$ | $1.3 \times 10^{-2}$ | $5.4 \times 10^{-8}$ |
| Ab9 | $9.0 \times 10^5$ | $9.0 \times 10^{-3}$ | $6.3 \times 10^{-8}$ |
| Ab10 | $<1.0 \times 10^0$ | $>1.0 \times 10^{-1}$ | $>1.0 \times 10^{-1}$ |
| Ab11 | $<1.0 \times 10^0$ | $>1.0 \times 10^{-1}$ | $>1.0 \times 10^{-1}$ |
| Ab12 | $<1.0 \times 10^0$ | $>1.0 \times 10^{-1}$ | $>1.0 \times 10^{-1}$ |
| Ab13 | $<1.0 \times 10^0$ | $>1.0 \times 10^{-1}$ | $>1.0 \times 10^{-1}$ |
| Ab15 | $<1.0 \times 10^0$ | $>1.0 \times 10^{-1}$ | $>1.0 \times 10^{-1}$ |
| Ab17 | $<1.0 \times 10^0$ | $>1.0 \times 10^{-1}$ | $>1.0 \times 10^{-1}$ |
| Ab1.H | $<1.0 \times 10^0$ | $>1.0 \times 10^{-1}$ | $>1.0 \times 10^{-1}$ |
| Ab2.H | $<1.0 \times 10^0$ | $>1.0 \times 10^{-1}$ | $>1.0 \times 10^{-1}$ |
| Ab3.H | $<1.0 \times 10^0$ | $>1.0 \times 10^{-1}$ | $>1.0 \times 10^{-1}$ |
| Ab4.H | $<1.0 \times 10^0$ | $>1.0 \times 10^{-1}$ | $>1.0 \times 10^{-1}$ |
| Ab6.H | $2.4 \times 10^5$ | $4.0 \times 10^{-3}$ | $1.6 \times 10^{-8}$ |
| Ab7.H | $2.5 \times 10^5$ | $9.4 \times 10^{-3}$ | $3.7 \times 10^{-8}$ |
| Ab7A.H | $2.7 \times 10^5$ | $1.3 \times 10^{-2}$ | $4.8 \times 10^{-8}$ |
| Ab10.H | $<1.0 \times 10^0$ | $>1.0 \times 10^{-1}$ | $>1.0 \times 10^{-1}$ |
| Ab11.H | $<1.0 \times 10^0$ | $>1.0 \times 10^{-1}$ | $>1.0 \times 10^{-1}$ |
| Ab11A.H | $<1.0 \times 10^0$ | $>1.0 \times 10^{-1}$ | $>1.0 \times 10^{-1}$ |
| Ab12.H | $<1.0 \times 10^0$ | $>1.0 \times 10^{-1}$ | $>1.0 \times 10^{-1}$ |

TABLE 6-continued

| Antibody | Ka (1/Ms) | Kd (1/s) | $K_D$ (M) |
|---|---|---|---|
| Ab13.H | $<1.0 \times 10^0$ | $>1.0 \times 10^{-1}$ | $>1.0 \times 10^{-1}$ |
| Ab15.H | $<1.0 \times 10^0$ | $>1.0 \times 10^{-1}$ | $>1.0 \times 10^{-1}$ |
| Ab17.H | $<1.0 \times 10^0$ | $>1.0 \times 10^{-1}$ | $>1.0 \times 10^{-1}$ |

Example 3 Inhibition of ACTH-Induced Signaling Via MC1R

CHO-K1 cells expressing MC1R with a beta-lactamase reporter gene under the control of a cAMP response element (Life Technologies) were used in a GeneBLAzer FRET cell based assay. Cells were grown in DMEM supplemented with 10% dialyzed FBS, 10 mM glutamax, 0.1 mM non-essential amino acids, 25 mM HEPES, and 600 ug/ml Hygromycin. The day before the assay the cells were detached with 0.25% trypsin, counted using a hemacytometer and adjusted to $2 \times 10^5$ cells/ml in growth media. 100 ul/well was plated in a 96-well black wall clear bottom plate. On the day of the assay anti-ACTH antibody dilutions starting at 40 nM were incubated in the presence of 5 nM ACTH (American Peptide) for 1 hr at 37 C. The media was removed from the MC1R cells and replaced with assay media alone, supplemented with ACTH, or ACTH incubated in the presence of the various antibody dilutions. All conditions were performed in duplicate. The cells were incubated for 4 hours and then loaded with 20 µl 6× substrate loading solution (Life Technologies) for 2 hours and read at an excitation wavelength of 409 nm and emission wavelengths 460 and 530 nm. The ratio of blue (460 nm) to green (530 nm) was used for plotting.

Results

FIG. 18 and FIG. 47 are representative of the inhibition curves obtained by this method (results are shown for Ab1 and Ab13, respectively). The computed IC50 values for each antibody (shown in Table 7, below) demonstrate that Ab1-Ab7 and Ab9-Ab13, Ab15, Ab17, Ab1.H-Ab7.H, Ab7A.H, Ab10.H-Ab13.H, Ab11A.H, Ab15.H, and Ab17.H inhibited ACTH-induced cAMP in cells expressing MC1R.

TABLE 7

Inhibition (IC50) of ACTH induced cAMP in cells expressing MC1R by anti-ACTH antibodies.

| ANTIBODY | MC1R $IC_{50}$ nM |
|---|---|
| Ab1 | 2.38 |
| Ab2 | 3.62 |
| Ab3 | 4.12 |
| Ab4 | 5.73 |
| Ab5 | 1.96 |
| Ab6 | 1.04 |
| Ab7 | 1.29 |
| Ab9 | 1.32 |
| Ab10 | 2.14 |
| Ab11 | 1.49 |
| Ab12 | 1.66 |
| Ab13 | 2.06 |
| Ab15 | 2.11 |
| Ab17 | 2.56 |
| Ab1.H | 1.36 |
| Ab2.H | 2.67 |
| Ab3.H | 2.06 |
| Ab4.H | 2.27 |
| Ab6.H | 1.83 |
| Ab7.H | 1.64 |

TABLE 7-continued

Inhibition (IC50) of ACTH
induced cAMP in cells expressing
MC1R by anti-ACTH antibodies.

| ANTIBODY | MC1R IC$_{50}$ nM |
|---|---|
| Ab7A.H | 1.19 |
| Ab10.H | 0.54 |
| Ab11.H | 1.37 |
| Ab11A.H | 0.95 |
| Ab12.H | 1.99 |
| Ab13.H | 1.32 |
| Ab15.H | 2.10 |
| Ab17.H | 1.56 |

Example 4 Inhibition of ACTH-Induced Signaling Via MC3R, MC4R and MC5R

Methods

For Ab1-Ab7 and Ab9, CHO-K1 cells expressing MC3R, MC4R or MC5R with a reporter gene under the control of a cAMP response element (Life Technologies) were used in a Meso Scale Discovery assay measuring cAMP. Cells were grown in DMEM supplemented with 10% dialyzed FBS, 10 mM glutamax, 0.1 mM non-essential amino acids, 25 mM HEPES, 5 µg/ml blasticidin and 600 µg/ml Hygromycin (MC3R), 100 g/ml Zeocin (MC4R) or 400 µg/ml Hygromycin (MC5R). The day of the assay the cells were detached with 5 mM EDTA, counted using a hemacytometer and adjusted to $2 \times 10^6$ cells/ml in Hepes buffered saline plus MgCl2, pH 7.3 (assay buffer). A 1:2 dilution series of anti-ACTH antibodies were incubated in the presence of ACTH (American Peptide or Bachem) for 1 hour at 37° C. For MC3R and MC4R, antibody concentrations started at 833 nM and ACTH was used at 100 nM. For MC5R, antibody concentrations started at 17 µM and ACTH was used at 5 µM. Twenty microliters of the assay buffer, ACTH or antibody/ACTH mixture was then added to the assay plate, followed by 10 µl of cells. After a 30 minute incubation at room temperature with shaking, the cells were lysed with 20 µl assay buffer plus Triton X-100 supplemented with 2.5 nM TAG-cAMP for 1 hour at room temperature with shaking. Finally 100 µl of 1.5× Read buffer T was added to each well and read on a Sector Imager 2400.

For Ab10-Ab3, Ab15, Ab17, Ab1.H-Ab7.H, Ab7A.H, Ab10.H-Ab13.H, Ab11A.H, Ab15.H, and Ab17.H, to identify antibodies that neutralize ACTH 1-39 induced signaling via MC3R or MC4R, antibody solutions were incubated with ACTH (1-39) at 4× the final concentration (250 nM) for 1 hr. While the antibody/antigen complexes were incubated for 1 hour, MC3R or MC4R cells (Life Technologies) were detached with 0.25% trypsin for 4 minutes. The cells were washed and re-suspended at $1 \times 10^6$ cells per ml culture media. Twenty microliters of Ab/antigen mixture was mixed with 20 µl of cells in HTRF plates and incubated with shaking for 30 minutes. Twenty microliters of Eu3+ cryptate labeled anti-cAMP MAb and 20 µl d2-labeled cAMP was added to each well and incubated for 1 hour with shaking. Fluorescence was measured at 620 and 665 nM with a delay of 300 µsec.

Also Ab10-Ab13, Ab15, Ab17, Ab1.H-Ab7.H, Ab7A.H, Ab10.H-Ab13.H, Ab11A.H, Ab15.H, and Ab17.H, to identify antibodies that neutralize ACTH 1-39 induced signaling via MC5R, antibody solutions were incubated with ACTH (1-39) at 4× the final concentration (10 uM) for 1 hr. While the antibody/antigen complexes were incubated for 1 hour, MC5R cells (Life Technologies) were detached with 0.25% trypsin for 4 minutes. The cells were washed and re-suspended at $1 \times 10^6$ cells per ml culture media. Twenty microliters of Ab/antigen mixture was mixed with 20 µl of cells in HTRF plates and incubated with shaking for 30 minutes. Twenty microliters of Eu3+ cryptate labeled anti-cAMP MAb and 20 µl d2-labeled cAMP was added to each well and incubated for 1 hour with shaking. Fluorescence was measured at 620 and 665 nM with a delay of 300 µsec.

Results

FIGS. 19, 20, and 21 are representative of the observed antibody inhibition of ACTH induced cAMP in cells expressing MC3R, MC4R, and MC5R respectively (results are shown for Ab1). FIGS. 48, 49, and 50 are representative of the observed antibody inhibition of ACTH induced cAMP in cells expressing MC3R, MC4R, and MC5R respectively (results are shown for Ab13). The computed IC50 values for each antibody (shown in Table 8, below) demonstrate that Ab1-Ab7 and Ab9-Ab13, Ab15, Ab17, Ab1.H-Ab7.H, Ab7A.H, Ab10.H-Ab13.H, Ab11A.H, Ab15.H, and Ab17.H inhibited ACTH-induced cAMP in cells expressing MC3R, MC4R, and MC5R.

TABLE 8

Inhibition (IC50) of ACTH induced
cAMP in cells expressing MC3R, MC4R, and
MC5R by anti-ACTH antibodies.

| ANTIBODY | MC3R IC$_{50}$ nM | MC4R IC$_{50}$ nM | MC5R IC$_{50}$ µM |
|---|---|---|---|
| Ab1 | 101.0 | 56.4 | 1.1 |
| Ab2 | 79.0 | 54.5 | 1.1 |
| Ab3 | 58.7 | 54.2 | 1.1 |
| Ab4 | 113.0 | 65.8 | 1.3 |
| Ab5 | 58.1 | 43.4 | 1.0 |
| Ab6 | 62.8 | 55.2 | 1.0 |
| Ab7 | 64.2 | 49.7 | 1.1 |
| Ab9 | 55.7 | 50.6 | 1.1 |
| Ab10 | 133.2 | 66.3 | 5.4 |
| Ab11 | 108.3 | 49.4 | 4.2 |
| Ab12 | 99.7 | 50.6 | 5.4 |
| Ab13 | 141.3 | 71.4 | 4.7 |
| Ab15 | 135.9 | 93.9 | 6.1 |
| Ab17 | 138.9 | 94.4 | 5.9 |
| Ab1.H | 83.9 | 43.7 | 3.6 |
| Ab2.H | 65.6 | 46.3 | 2.4 |
| Ab3.H | 70.6 | 34.8 | 3.5 |
| Ab4.H | 87.7 | 41.8 | 3.1 |
| Ab6.H | 89.6 | 52.2 | 3.9 |
| Ab7.H | 94.4 | 49.3 | 4.7 |
| Ab7A.H | 92.3 | 55.9 | not determined |
| Ab10.H | 104.3 | 50.6 | 3.5 |
| Ab11.H | 57.8 | 33.8 | 3.8 |
| Ab11A.H | 59.1 | 35.9 | 3.1 |
| Ab12.H | 78.2 | 46.9 | 3.7 |
| Ab13.H | 64.9 | 46.9 | 3.1 |
| Ab15.H | 131.3 | 79.5 | 4.3 |
| Ab17.H | 109.9 | 81.6 | 4.0 |

Example 5 Inhibition of ACTH-Induced Cortisol Secretion by Y1 Cells

The Y-1 cell line (mouse adrenal cell line) (ATCC) secretes cortisol in response to ACTH stimulation. Cells were grown on collagen coated flasks in Ham's F-12K media supplemented with 15% Horse Serum and 2.5% FBS. Cells at 400,000 cells/ml were seeded at 100 µl per well into a collagen coated clear bottom black walled 96 well plate (Costar) and incubated overnight. The media was then changed to F12K supplemented with 1% BSA (assay media) and cells incubated overnight. Assay media supplemented with 3 nM ACTH (American Peptide or Bachem) was incubated in the presence of anti-ACTH antibody (1:3 dilution series starting at 81 nM) at 37° C. for 1 hour. The media was removed from the Y-1 cells and replaced with assay media alone, supplemented with ACTH, or ACTH incubated in the presence of the various antibodies. Treatment of the cells was for 24 hrs. The experimental media was removed from cells, diluted 1:10 and the cortisol level was determined with Cortisol parameter assay kit (R&D, Minneapolis, Minn.). Briefly microplate strips were incubated with 50 μl Primary Antibody solution (except non-standard binding wells) for 1 hour at room temperature with shaking. Plate was then washed 4× with 400 μl/well wash buffer. Then 100 μl standards and samples were added to the plate, followed by 50 μl cortisol conjugate. Plates were incubated 2 hours at room temperature with shaking and then washed as above. The plates were developed with 200 μl/well substrate solution for 30 minutes, followed by the addition of 50 μl/well stop solution. Plates were read at 450 nm with a 570 nm correction.

Results

FIG. 22 and FIG. 51 are representative of the observed antibody inhibition of ACTH induced cAMP in Y1 cells (results are shown for Ab1 and Ab13, respectively). The computed IC50 values for each antibody (shown in Table 9, below) demonstrate that Ab1-Ab7 and Ab9-Ab13, Ab15, Ab17, Ab1.H-Ab7.H, Ab7A.H, Ab10.H-Ab13.H, Ab11A.H, Ab15.H, and Ab17.H inhibited ACTH-induced cortisol in Y1 cells.

TABLE 9

Inhibition (IC50) of ACTH induced cortisol in Y1 cells by antibodies Ab1-Ab7 and Ab9-Ab12.

| ANTIBODY | Y1 Cells $IC_{50}$ nM |
|---|---|
| Ab1 | 2.36 |
| Ab2 | 2.35 |
| Ab3 | 7.72 |
| Ab4 | 17.19 |
| Ab5 | 3.49 |
| Ab6 | 1.44 |
| Ab7 | 2.49 |
| Ab9 | 3.47 |
| Ab10 | 5.98 |
| Ab11 | 1.53 |
| Ab12 | 2.68 |
| Ab13 | 2.35 |
| Ab15 | 1.84 |
| Ab17 | 4.47 |
| Ab1.H | 1.77 |
| Ab2.H | 1.96 |
| Ab3.H | 4.04 |
| Ab4.H | 2.43 |
| Ab6.H | 1.62 |
| Ab7.H | 2.05 |
| Ab7A.H | 2.26 |
| Ab10.H | 1.06 |
| Ab11.H | 0.97 |
| Ab11A.H | 2.53 |
| Ab12.H | 4.13 |
| Ab13.H | 1.91 |
| Ab15.H | 3.83 |
| Ab17.H | 4.30 |

Example 6 Reduction of Corticosterone Levels in Mice by Anti-ACTH Antibodies

A pharmacodynamics study was conducted in female C57BL/6 mice. Five mice were injected with buffer and groups of 10 mice were dosed with either 10 mg/kg of a control antibody of the same isotype (AD26-10), Ab2 or Ab3. Injections were performed by IV (tail vein) bolus administration on days 1 and day 7.

Blood samples were collected 24 hours before injection of test article (day 0), day 3, day 9 and day 12 in $K_3$EDTA tubes and processed to plasma for corticosterone analysis. All samples were stored at −70° C.

Corticosterone levels in mouse plasma samples were assessed using a Corticosterone EIA kit (Enzo Life Sciences) according to manufacturer's protocol. Briefly 100 μl plasma samples are diluted 1:20, standards and controls were added to assay plate, followed by 50 μl of an alkaline phosphatase conjugated corticosterone and 50 μl of a polyclonal Ab to corticosterone. Assay plate was incubated 2 hours at room temperature with shaking and then washed. It was developed with p-Npp for 1 hour and then read at 405 with a 570 nm subtraction.

Results: FIGS. 23-26 demonstrate that Ab2 and Ab3 decrease plasma corticosterone levels in mice.

Example 7 Reduction of Corticosterone Levels in Rats by Anti-ACTH Antibodies

A pharmacodynamics study was conducted in male Lewis rats. On day 1, rats were implanted with an Alzet pump (Durect #2ML1, 10 ul/hr for 7 days) delivering either vehicle or rat ACTH (Bachem) at a rate of 0.05 mg/kg/day. Twenty-four hours after pump implantation, the rats were injected with either 10 mg/kg of a control isotype antibody (AD26-10) or Ab6. Injections were performed by IV (tail vein) bolus administration. The study was terminated 6 days post antibody injection.

Body weights were recorded daily and blood samples were collected on day 0, 2, 3, 5, 7, and 8 in $K_3$EDTA tubes and processed to plasma for corticosterone and aldosterone analysis. All samples were stored at −70° C.

Corticosterone levels in rat plasma samples were assessed using a Corticosterone EIA kit (Enzo Life Sciences) according to manufacturer's protocol. Briefly 100 μl plasma samples were diluted 1:20, standards and controls were added to assay plate, followed by 50 μl of an alkaline phosphatase conjugated corticosterone and 50 μl of a polyclonal Ab to corticosterone. The assay plate was incubated 2 hours at room temperature with shaking and then washed. It was developed with p-Npp for 1 hour, then stopped and read at 405 with a 570 nm subtraction.

Results

FIG. 27 demonstrates Ab6 inhibited ACTH induced weight loss. A one-way analysis of variance (ANOVA) was performed. Plasma corticosterone and aldosterone levels at day 0 (before antibody administration or pump implantation) are shown in FIG. 28 and FIG. 34, respectively. Plasma corticosterone and aldosterone levels at day 2 (24 hours post pump implantation but pre-Ab dosing) are shown in FIG. 29 and FIG. 35, respectively. The results show that Ab6 reduced corticosterone (FIGS. 30-33) and aldosterone (FIGS. 36-39) levels at days 3, 5, 7, and 8, with statistically significant reductions observed in both corticosterone and aldosterone at days 3, 5, and 7, and at day 8 for aldosterone. A Mann-Whitney two-tailed P value analysis was performed comparing groups to the ACTH/AD26-10 group. Statistical significance values are as shown in the figures.

It was observed in some experiments that corticosterone levels varied from day to day, which was thought to result from varying levels of stress, e.g., as a result of handling the animals. Notwithstanding, consistent differences were observed between the control and treatment groups (as well as statistically significant differences between them), indicating effectiveness of the antibody at neutralizing ACTH activity in vivo.

Example 8 Epitope Mapping of Anti-ACTH Antibodies

ACTH peptides were synthesized with a single point mutation in each position replacing the native amino acid with an Alanine (Ala). In positions 27, 32 and 34 the native Ala was replaced with Valine (Val). Per the usual convention these mutants are identified by the position in ACTH 1-39 followed by the letter code for the substituted amino acid, e.g., 7A indicates ACTH 1-39 substituted with alanine at amino acid position 7. Binding of monoclonal antibodies for human ACTH and each mutant peptide was detected using Surface Plasmon Resonance (SPR) on the ProteOn™ XRP36 (Bio-Rad, Hercules, Calif.). Samples and sample controls were immobilized onto a GLC sensor chip at a single density using standard amine coupling. The running buffer for immobilization consisted of 1×HBS-EP+(10 mM HEPES, 150 mM NaCl, 3 mM EDTA, 0.05% Polysorbate 20, pH 7.6) and was carried out at 25 degrees C. The GLC chip was initialized and pre-conditioned per the manufacturer's protocol (bi-directional injections of 0.5% SDS, 50 mM NaOH, 100 mM HCl). The immobilization process was carried out step-wise to ensure a unique antibody on the spots of the ProteOn™ Chip. Activation of the surface was by a 1:1 mixture of EDAC/NHS and flow rate of 30 uL/min×6 minutes. Antibody samples were previously dialyzed or exchanged to 10 mM HEPES 150 mM NaCl pH 7.2 and the antibody concentration was quantified using a Nanodrop™2000 spectrophotometer (ThermoScientific). The immobilization targeted 2000-3000 RU. Antibody samples (10 ug/mL) in 10 mM Sodium Acetate, pH 5.5 were flowed at 30 uL/min×6 minutes. Deactivation was done at a flow rate of 30 uL/min for 6 minutes using 0.5M Ethanolamine concomitantly with the next activation.

Following immobilization, the running buffer was changed to 1×HBS-EP+ with BSA (0.2 mg/mL) (as a carrier) and Sodium Azide (4 uM) (as a preservative) and the chip surface was allowed to re-equilibrate with an injection of new running buffer. Stock solutions of human ACTH peptide (1-39) and alanine/valine mutant peptides (Molecular Weight(s): 4.5 kD) at (1 mg/mL) were added to the running buffer at concentrations of 0.45 µg/mL (100 nM) and used to query individual spots on the chip surface with flow rates of 100 uL/min×2 minutes and allowed to dissociate for 1000 seconds. Regeneration of surfaces between analytes was accomplished with Glycine 10 mM at pH 2.0. The tested antibodies were either the original rabbit sequence or humanized sequence variants of each of the subject antibodies, specifically, Ab1.H, Ab2.H, Ab3.H, Ab4.H, Ab5, Ab6.H, Ab7.H, Ab9, Ab10.H, Ab11.H, Ab11A.H, Ab12.H, Ab13.H, Ab15, and Ab17. The ".H" appended to a given antibody name indicates a humanized variant of the identified antibody. Ab11A.H is variant of Ab11.H containing a sequence difference within one of the CDRs, which was observed to cause a slight difference in epitope binding (one amino acid difference). Because the humanization process generally retains the binding specify of the antibody to the target the tested antibodies are interpreted to bind to the same epitopes as their respective parent antibodies.

Sensorgrams representing affinity data of mutant peptide binding to a panel of antibodies were assessed via multiple measures. A visual inspection was first performed for each sensorgram to assess apparent maximal response (Rmax) relative to the native ACTH peptide (1-39). Second, a visual inspection of the dissociation phase was performed with an emphasis on the curve shape relative to the native ACTH peptide. Off-rates were calculated for native ACTH peptide and binding of each mutant peptide to the panel of antibodies. Finally, to confirm the integrity of each peptide reagent, each member of the peptide library was individually assessed to a broad panel of antibodies to ensure each peptide displayed binding activity similar to the native peptide to at least one antibody. The determination of amino acids residues important for antibody binding were made based on the collective assessment of all parameters described.

Results

Binding and dissociation curves are shown in FIG. 40A-O for binding of antibodies Ab1.H, Ab2.H, Ab3.H, Ab4.H, Ab5, Ab6.H, Ab7.H, Ab9, Ab10.H, Ab11.H, Ab11A.H, Ab12.H, Ab13.H, Ab15, and Ab17. The upper panel shows the binding curves for positions important for antibody binding (labeled at the right end, e.g., "21A" indicates the binding curve for the alanine scan mutant containing Alanine at position 21). The lower panel shows the binding of the remaining mutant positions, i.e., those determined not to be important for antibody binding. For reference, both panels also show the binding curve for wild-type ACTH (labeled huACTH(1-39)).

FIG. 41 tabulates the effects of all of the ACTH mutants on antibody binding. The positions listed in each column identify the alanine scanning mutants that were determined to be important for antibody binding; these are shown in order of position in order to illustrate the spatial arrangement of the residues along the ACTH primary sequence. The positions important for antibody binding were interpreted to jointly make the epitopes bound by each antibody. Based on these results, the epitopes bound by each antibody were concluded to be as follows:

Ab1 or Ab1.H: epitope containing residues 16, 18, and 20-23 of human ACTH.

Ab2 or Ab2.H: epitope containing residues 16, 18, and 20-23 of human ACTH.

Ab3 or Ab3.H: epitope containing residues 16, 18, and 20-23 of human ACTH.

Ab4 or Ab4.H: epitope containing residues 16, 18, and 20-23 of human ACTH.

Ab5: epitope containing residues 7-11, 13-14, and 18-19 of human ACTH.

Ab6 or Ab6.H: epitope containing residues 7-11, 13-14, 16, 18-19, and 23 of human ACTH.

Ab7 or Ab7.H: epitope containing residues 7-11, 13-14, and 18-19 of human ACTH.

Ab9: epitope containing residues 7-11, 14, and 18 of human ACTH.

Ab10 or Ab10.H: epitope containing residues 16, 18, and 20-23 of human ACTH.

Ab11 or Ab11.H: epitope containing residues 16-18 and 20-23.

Ab1A.H: epitope containing residues 16-23 of human ACTH.

Ab12 or Ab12.H: epitope containing residues 16-23 of human ACTH.

Ab13 or Ab13.H: epitope containing residues 17-23 of human ACTH.

Ab15: epitope containing residues 17-23 of human ACTH.

Ab17: epitope containing residues 17-23 of human ACTH.

From these results it was further noted that the antibodies can be divided into two groups based upon the amount of overlap between the residues forming the epitope. One group contains antibodies Ab1-Ab4, Ab10-Ab13, Ab15, Ab17, Ab1.H-Ab4.H, Ab10.H, Ab11.H, Ab11A.H, and Ab13.H that each bind to residues 16, 18, and 20-23 of human ACTH, and optionally further bind to residues 17 and/or 19. The second group includes antibodies Ab5-Ab7 and Ab9 that each bind to residues 7-11, 14, and 18 of human ACTH, and optionally further bind to residues 13, 16, and/or 19. From these results it was concluded that an antibody that binds to the same epitope as any of these antibodies, or overlaps in binding with residues of either or both of these epitopes, would likely have similar biological activity as the subject antibodies, including the ability to block MCR activation and inhibit the release of cortisol and aldosterone in vivo. Additionally, antibodies that bind to these epitopes or a subset of residues thereof are predicted to resemble the subject antibodies in their binding affinity characteristics (e.g., selectivity or differential binding ability), including exhibiting stronger affinity for ACTH than for alpha-MSH or CLIP (such as at least 10-fold, at least 100-fold, or at least 1000-fold stronger affinity for human ACTH than for alpha-MSH or CLIP or for both alpha-MSH and CLIP, i.e., a numerically lower $K_D$ for ACTH than for alpha-MSH or CLIP by at least 10-fold, at least 100-fold, or at least 1000-fold).

Example 9 Anti-ACTH Antibodies Inhibit Binding of ACTH to MC2R

Inhibition of ACTH binding to the melanocortin-2 receptor (MC2R) was determined using ACTH (1-39) 23 TYR, [125I](Perkin Elmer) and an MC2R transfected cell line (Invitrogen). Briefly, MC2R cells were cultured to logarithmic growth in DMEM containing 10% dialyzed FBS, L-glutamine, NEAA, and HEPES. Selection pressure for MC2R expression was maintained on the cells using Blasticidin, Zeocin, and Hygromycin at 5, 100, and 600 g/ml, respectively. Cells were harvested and plated on Perkin Elmer Cytostar-T™ Scintillating Microplates at 4×10⁴ cells/well in 100 μL of media and incubated at 35-38° C. in 5% $CO_2$ for 18-24 hours. Following incubation cells were aspirated of media and 100 μL of DMEM containing 2% BSA (DMEM-BSA) was added to each well. Cells were incubated until the treatment solution was prepared.

The $^{125}$I-ACTH tracer solution was prepared by adding 40 μL of the ACTH (1-39) 23 TYR, [125I] to 10 ml of DMEM-BSA (final concentration with cell 6.4 pM). Each antibody to be evaluated was prepared as a 1 mg/ml intermediate stock in DMEM-BSA from a 5 mg/ml master stock. Each antibody solution (20 μl) and $^{125}$I-ACTH tracer (480 μl) were combined and incubated for 30 minutes at 35-38° C. Cells were aspirated and incubated in the presence of $^{125}$I-ACTH tracer (Max binding), $^{125}$I-ACTH tracer + antibody, or $^{125}$I-ACTH tracer+ACTH, 1 μM (ACTH control) for 1 hour at 35-38° C. in 5% $CO_2$. Nonspecific background binding was determined by adding the $^{125}$I-ACTH tracer to cell-free wells (Background). At the end of incubation period wells were analyzed for $^{125}$I-ACTH tracer binding using a MicroBeta® Trilux (Perkin Elmer) to determine the calculated counts per minute of each well.

Results

FIG. 42 shows that all anti-ACTH antibodies completely inhibited ACTH binding to MC2R (similar to the background level measured in the absence of cells, which is shown in the second bar from the left) within the limits of detection of the assay. As expected, three negative control antibodies (three rightmost bars) fail to inhibit ACTH binding as indicated by similar to levels detected in the absence of antibody (leftmost bar). The third to fourteenth columns from left to right in the bar graph correspond to the results for the tested antibodies.

These results indicate that the mechanism by which the subject anti-ACTH antibodies inhibit activation of MC2R is by preventing binding of ACTH to this receptor. From these results it is predicted that activation of the other MCRs (MC1R, MC3R, MC4R, and MC5R) is by a similar mechanism, i.e., by decreasing or abolishing ACTH binding to the MCRs.

Example 10 Recognition of ACTH 1-24 by Recombinant Antibodies by ELISA

ACTH is a 39 amino acid peptide but analyses of various truncated ACTH peptides have demonstrated ACTH 1-24 has full agonist activity of MC2R (Chen et al., *Biochemistry* 2007; 46 (40): 11389-11397). The peptide sequence of ACTH 1-24 is fully conserved (100% identity) among mammalian species including human (SEQ ID NO: 1122), horse (*Equus przewalskii*, NCBI Accession No. XP_008513480), cat (*Felis catus*, NCBI Accession No. XP_003984482), and dog (*canus* lupus *familiaris*, NCBI accession no. AAK08973). In Example 9, above, it was demonstrated that each of the tested antibodies recognized ACTH epitopes exclusively contained in ACTH 1-24. Additionally, Ab1-Ab7 and Ab9 bind ACTH 1-24 with similar affinity to ACTH 1-39 (data not shown). Taken together, these results strongly suggest that the subject anti-ACTH antibodies would be able to bind to the conserved ACTH 1-24 sequence within of horse, dog, and cat ACTH and thereby inhibit biological activities of ACTH in these species. This was further assessed by determining whether the anti-ACTH antibodies could block MC2R receptor activation by the ACTH 1-24 peptide sequence that is 100% conserved among humans, horses, dogs, and cats.

Methods

To assess neutralization of ACTH 1-24 induced signaling via MC2R, antibody solutions were incubated with ACTH (1-24) at 4× the final concentration (600 pM) for 1 hr. While the antibody/antigen complexes were incubated for 1 hour, MC2R cells (Life Technologies) were detached with 0.25% trypsin for 4 minutes. The cells were washed and re-suspended at 1×106 cells per ml culture media. Twenty microliters of Ab/antigen mixture was mixed with 20 μl of cells in HTRF plates and incubated with shaking for 30 minutes. Twenty microliters of Eu3+ cryptate labeled anti-cAMP MAb and 20 μl d2-labeled cAMP was added to each well and incubated for 1 hour with shaking. Fluorescence was measured at 620 and 665 nM with a delay of 300 μsec.

Results

FIG. 43 and FIG. 44 shows an inhibition curves (for Ab2 and Ab13.H, respectively) that are representative of the inhibition curves obtained with the other tested antibodies. The inhibition results were quantified for each antibody to yield an IC50 value, which are summarized in Table 10 below. These results demonstrated that anti-ACTH antibodies Ab2, Ab2.H, Ab3, Ab3.H, Ab6, Ab6.H, Ab13, and Ab13.H inhibited ACTH 1-24 induced cAMP in cells expressing MC2R. Notably, the antibodies tested were representative of the two different epitope groups identified in Example 9, indicating that the antibodies of either group would have similar therapeutic activity in veterinary applications.

TABLE 10

IC50 (nM) for antibody inhibition of MC2R receptor activation by the ACTH 1-24 peptide.

| Antibody | IC50 (nM) |
|---|---|
| Ab2 | 1.3 |
| Ab2.H | 0.6 |
| Ab3 | 0.8 |
| Ab3.H | 0.4 |
| Ab6 | 0.1 |
| Ab6.H | 0.1 |
| Ab13 | 1.0 |
| Ab13.H | 0.3 |

Example 11 Yeast Cell Expression

Construction of *Pichia pastoris* Expression Vectors for Heavy and Light Chain.

The humanized variable light and heavy chain fragments were amplified from the mammalian expression vectors using PCR and subcloned into a pGAP expression vector. The pGAP expression vector uses the GAP promoter to drive expression of the immunoglobulin chain and a secretion leader sequence for export. In addition, this vector contains common elements such as a bacterial origin of replication, and a copy of an antibiotic resistance gene for selection of transformants that contain the desired expression vector integrated into their genome. For the vectors targeting integration into the GAP promoter locus of the *P. pastoris* genome, the pGAP vector carries an expression cassette for the kanamycin resistance gene which confers resistance to the antibiotic G418. For the vector targeting integration into the HIS4 TT locus of the *P. pastoris* genome, the pGAP vector carries an expression cassette for the Sh ble gene that permits selection of transformants with the antibiotic Zeocin.

Transformation of Expression Vectors into Haploid Met1 and Lys3 Host Strains of *Pichia pastoris*

All methods used for transformation of haploid *P. pastoris* strains were done as described in Lin-Cereghino et al., *Biotechniques*. 2005 January; 38(1):44, 46, 48. Prior to transformation each vector was linearized within the GAP promoter sequences to direct the integration of the vector into the GAP promoter locus of the *P. pastoris* genome. Haploid strains were transfected using electroporation and successful transformants were selected on YPDS (yeast extract, peptone dextrose with sorbitol) G418 agar plates. Copy numbers of heavy and light chain genes were determined for haploid strains by Southern blot analysis. Dual locus strains were generated using the methods disclosed in U.S. Pre-Grant Patent Publication No. 2013/0045888, the contents of which are incorporated by reference in its entirety. Briefly, a haploid containing two copies of the heavy chain expression vector integrated at pGAP was identified and retransformed with a heavy chain expression vector targeting integration into the HIS4 TT locus. Transformants containing copies of heavy chain expression vectors integrated at both the GAP promoter and HIS4 TT loci were selected on YPDS plates containing G418 and Zeocin. Haploid strains were then mated and selected for their ability to grow in the absence of the amino acid markers (i.e., Lys and Met). Resulting diploid clones were then subjected to a final Southern blot to confirm copy numbers of heavy and light chain genes. A clone expressing the antibody of interest was characterized using biolayer interferometry Protein-A biosensors to monitor expression (Octet, ForteBio).

Example 12 Expression of Ab1.H, Ab2.H, Ab3.H, Ab4.H, Ab11.H, Ab11A.H, Ab12.H, and Ab13.H in *Pichia pastoris*

*Pichia* strains for expression of full-length antibody were made. For all the full length antibody expressing strains, haploids strains were created and subsequently mated. One haploid strain expressed full-length light chain sequence and another haploid strain expressed the full-length heavy chain sequence. Each diploid strain was used to generate a research cell bank and used for expression in a bioreactor.

First an inoculum was expanded using the research cell bank using medium comprised of the following nutrients (% w/v): yeast extract 3%, glycerol 2%, YNB 1.34%, Biotin 0.004% and 200 mM potassium phosphate. To generate the inoculum for the fermenters, the cell bank was expanded for approximately 29 hours in a shaking incubator at 30° C. and 300 RPM. A 10% inoculum was then added to Labfors 2.5 L working volume vessels containing 1 L sterile growth medium. The growth medium was comprised of the following nutrients: potassium sulfate 18.2 g/L, ammonium phosphate monobasic 35.6 g/L, potassium phosphate dibasic 12.8 g/L, magnesium sulfate heptahydrate 3.72 g/L, sodium citrate dihydrate 10 g/L, glycerol 40 g/L, yeast extract 30 g/L, PTM1 trace metals 4.35 mL/L, and antifoam 204 1.67 mL/L. The PTM1 trace metal solution was comprised of the following components: cupric sulfate pentahydrate 6 g/L, sodium iodide 0.08 g/L, manganese sulfate hydrate 3 g/L, sodium molybdate dehydrate 0.2 g/L, boric acid 0.02 g/L, cobalt chloride 0.5 g/L, zinc chloride 20 g/L, ferrous sulfate heptahydrate 65 g/L, biotin 0.2 g/L, and sulfuric acid 5 mL/L.

The bioreactor process control parameters were set as follows: Agitation 1,000 RPM, airflow 1.35 standard liter per minute, temperature 28° C. and pH was controlled at six using ammonium hydroxide. No oxygen supplementation was provided.

Fermentation cultures were grown for approximately 12 to 16 hours until the initial glycerol was consumed as denoted by a dissolved oxygen spike. Immediately following the dissolved oxygen spike, a bolus addition of ethanol was added to the reactor to reach 1% ethanol (w/v). The fermentation cultures were allowed to equilibrate for 15 to 30 minutes. Feed addition was initiated 30 minutes post-ethanol bolus and set at a constant rate of 0.5 mL/min for 40 minutes, then the feed pump was controlled by an ethanol sensor keeping the concentration of ethanol at 1% for the remainder of the run using an ethanol sensing probe (Raven Biotech). The feed was comprised of the following components: yeast extract 50 g/L, anhydrous dextrose 500 g/L, sodium citrate dehydrate 0.5 g/L and PTM1 trace metals 12 mL/L. The total fermentation time was approximately 86 hours.

Example 13 Reduction of Corticosterone Levels in Rats by Anti-ACTH Antibodies

A pharmacodynamics study was conduced in male Lewis rats. On day 1, rats were implanted with an Alzet pump (Durect #2ML1, 10 ul/hr for 8 days) delivering either vehicle or rat ACTH (Bachem) at a rate of 0.05 mg/kg/day. Twenty-four hours later the rats were injected with either 10 mg/kg of a control isotype antibody (AD26-10) or Ab1.H. Injections were performed by IV (tail vein) bolus administration. The study was terminated 8 days post antibody injection.

Body weights were recorded daily and blood samples were collected on day 0, 2, 3, 5, 7, and 8 in $K_3$EDTA tubes and processed to plasma for corticosterone and aldosterone analysis. All samples were stored at −70° C.

Corticosterone levels in rat plasma samples were assessed using a Corticosterone EIA kit (Enzo Life Sciences) according to the manufacturer's protocol. Briefly, 100 µl plasma samples were diluted 1:20, standards and controls were added to the assay plate, followed by 50 µl of an alkaline phosphatase conjugated corticosterone and 50 µl of a polyclonal Ab to corticosterone. The assay plate was incubated 2 hours at room temperature with shaking and then washed. It was developed with p-Npp for 1 hour, then stopped and read at 405 with a 570 nm subtraction.

Aldosterone levels in rat plasma samples were assessed using an aldosterone EIA kit (Enzo Life Sciences) according to the manufacturer's protocol. Briefly, 100 µl plasma samples were diluted 1:10, standards and controls were added to the assay plate, followed by 50 µl of an alkaline phosphatase conjugated aldosterone and 50 µl of a polyclonal Ab to aldosterone. The assay plate was incubated 16-24 hours at 4 C and then washed. It was developed with p-Npp for 1 hour, then stopped and read at 405 with a 570 nm subtraction.

Results

FIGS. 52-64 show the effects of Ab1.H on changes in body weight, serum corticosterone, and serum aldosterone levels that resulted from ACTH dosing. FIG. 52 shows the percentage change in animal weight by day over the course of the study, and shows that Ab1.H inhibited ACTH-induced weight loss. FIGS. 53 and 59 respectively show plasma corticosterone and aldosterone levels before ACTH and antibody dosing. FIGS. 54 and 60 respectively show plasma corticosterone and aldosterone levels at 24 hours after initiation of ACTH dosing and before the antibody administration. FIGS. 55 and 61 respectively show plasma corticosterone and aldosterone levels 48 hours after initiation of ACTH dosing and 24 hours after the antibody administration. FIGS. 56 and 62 respectively show plasma corticosterone and aldosterone levels 96 hours after initiation of ACTH dosing and 72 hours after the antibody administration. FIGS. 57 and 63 respectively show plasma corticosterone and aldosterone levels 144 hours after initiation of ACTH dosing and 120 hours after the antibody administration. FIGS. 58 and 64 respectively show plasma corticosterone and aldosterone levels 168 hours after initiation of ACTH dosing and 144 hours after the antibody administration. The results of statistical comparison between treatment groups at the varying time points are as indicated in the figures, and indicate statistically significant decreases in corticosterone and aldosterone caused by Ab1.H in the ACTH treatment group relative to animals treated with the isotype control, as well as statistically significant increases in corticosterone and aldosterone caused by ACTH dosing relative to vehicle-treated controls.

Overall, FIGS. 52-64 demonstrate that Ab1.H reduced corticosterone and aldosterone levels, and inhibited ACTH-induced weight loss.

Example 14 Reduction of Corticosterone Levels in Rats by Anti-ACTH Antibodies

A pharmacodynamics study was conduced in male Lewis rats. On day 1, rats were implanted with an Alzet pump (Durect #2ML1, 10 ul/hr for 7 days) delivering either vehicle or rat ACTH (Bachem) at a rate of 0.05 mg/kg/day. Twenty-fours hours later the rats were injected with either 10 mg/kg of a control antibody of the same isotype (AD26-10), Ab7A.H Ab10.H, Ab11.H, Ab12.H, Ab13.H, Ab15.H, Ab1A.H, or Ab15.H, or with Ab2.H at 100 mg/kg Injections were performed by IV (tail vein) bolus administration. The study was terminated 7 days post antibody injection.

Body weights were recorded daily and blood samples were collected on day 0, 2, 3, 5, and 7 in $K_3$EDTA tubes and processed to plasma for corticosterone and aldosterone analysis. All samples were stored at −70° C.

Corticosterone levels in rat plasma samples were assessed using a Corticosterone EIA kit (Enzo Life Sciences) according to manufacturer's protocol. Briefly 100 µl plasma samples were diluted 1:100, standards and controls were added to assay plate, followed by 50 µl of an alkaline phosphatase conjugated corticosterone and 50 µl of a polyclonal Ab to corticosterone. The assay plate was incubated 2 hours at room temperature with shaking and then washed. It was developed with p-Npp for 1 hour, then stopped and read at 405 with a 570 nm subtraction.

Aldosterone levels in rat plasma samples were assessed using an aldosterone EIA kit (Enzo Life Sciences) according to the manufacturer's protocol. Briefly, 100 µl plasma samples were diluted 1:10, standards and controls were added to the assay plate, followed by 50 µl of an alkaline phosphatase conjugated aldosterone and 50 µl of a polyclonal Ab to aldosterone. The assay plate was incubated 16-24 hours at 4 C and then washed. It was developed with p-Npp for 1 hour, then stopped and read at 405 with a 570 nm subtraction.

Results

FIGS. 65-75 show the effects of Ab2.H, Ab11.H, and Ab12.H on changes in body weight, serum corticosterone, and serum aldosterone levels that resulted from ACTH dosing. FIG. 65 shows the percentage change in animal weight by day over the course of the study, and shows that Ab2.H, Ab11.H, and Ab12.H inhibited ACTH-induced weight loss. FIGS. 66 and 71 respectively show plasma corticosterone and aldosterone levels before ACTH and antibody dosing. FIGS. 67 and 72 respectively show plasma corticosterone and aldosterone levels at 24 hours after initiation of ACTH dosing and before the antibody administration. FIGS. 68 and 73 respectively show plasma corticosterone and aldosterone levels 48 hours after initiation of ACTH dosing and 24 hours after the antibody administration. FIGS. 69 and 74 respectively show plasma corticosterone and aldosterone levels 96 hours after initiation of ACTH dosing and 72 hours after the antibody administration. FIGS. 70 and 75 respectively show plasma corticosterone and aldosterone levels 144 hours after initiation of ACTH dosing and 120 hours after the antibody administration. The results of statistical comparison between treatment groups at the varying time points are as indicated in the figures, and indicate statistically significant decreases in corticosterone and aldosterone caused by Ab2.H, Ab11.H, and Ab12.H in the ACTH treatment group relative to animals treated with the isotype control, as well as statistically significant increases in aldosterone caused by ACTH dosing relative to vehicle-treated controls.

Overall, FIGS. 65-75 demonstrate that Ab2.H, Ab1.H, and Ab12.H inhibited ACTH-induced weight loss and ACTH-induced increases in corticosterone and aldosterone levels.

FIGS. 76-86 show the effects of Ab10.H on changes in body weight, serum corticosterone, and serum aldosterone levels that resulted from ACTH dosing. FIG. 76 shows the percentage change in animal weight by day over the course of the study, and shows that Ab10.H inhibited ACTH-induced weight loss. FIGS. 77 and 82 respectively show plasma corticosterone and aldosterone levels before ACTH and antibody dosing. FIGS. 78 and 83 respectively show plasma corticosterone and aldosterone levels at 24 hours after initiation of ACTH dosing and before the antibody administration. FIGS. 79 and 84 respectively show plasma corticosterone and aldosterone levels 48 hours after initiation of ACTH dosing and 24 hours after the antibody administration. FIGS. 80 and 85 respectively show plasma corticosterone and aldosterone levels 96 hours after initiation of ACTH dosing and 72 hours after the antibody administration. FIGS. 81 and 86 respectively show plasma corticosterone and aldosterone levels 144 hours after initiation of ACTH dosing and 120 hours after the antibody administration. The results of statistical comparison between treatment groups at the varying time points are as indicated in the figures, and indicate statistically significant decreases in corticosterone and aldosterone caused by Ab10.H in the ACTH treatment group relative to animals treated with the isotype control, as well as statistically significant increases in corticosterone and aldosterone caused by ACTH dosing relative to vehicle-treated controls.

Overall, FIGS. 76-86 demonstrate that Ab10.H inhibited ACTH-induced weight loss and ACTH-induced increases in corticosterone and aldosterone levels.

FIGS. 87-97 show the effects of Ab13.H on changes in body weight, serum corticosterone, and serum aldosterone levels that resulted from ACTH dosing. FIG. 87 shows the percentage change in animal weight by day over the course of the study, and shows that Ab13.H inhibited ACTH-induced weight loss. FIGS. 88 and 93 respectively show plasma corticosterone and aldosterone levels before ACTH and antibody dosing. FIGS. 89 and 94 respectively show plasma corticosterone and aldosterone levels at 24 hours after initiation of ACTH dosing and before the antibody administration. FIGS. 90 and 95 respectively show plasma corticosterone and aldosterone levels 48 hours after initiation of ACTH dosing and 24 hours after the antibody administration. FIGS. 91 and 96 respectively show plasma corticosterone and aldosterone levels 96 hours after initiation of ACTH dosing and 72 hours after the antibody administration. FIGS. 92 and 97 respectively show plasma corticosterone and aldosterone levels 144 hours after initiation of ACTH dosing and 120 hours after the antibody administration. The results of statistical comparison between treatment groups at the varying time points are as indicated in the figures, and indicate statistically significant decreases in corticosterone and aldosterone caused by Ab13.H in the ACTH treatment group relative to animals treated with the isotype control, as well as statistically significant increases in corticosterone and aldosterone caused by ACTH dosing relative to vehicle-treated controls.

Overall, FIGS. 87-97 demonstrate that Ab13.H inhibited ACTH-induced weight loss and ACTH-induced increases in corticosterone and aldosterone levels.

FIGS. 98-108 show the effects of Ab7A.H (labeled in the figure as Ab7A.H) on changes in body weight, serum corticosterone, and serum aldosterone levels that resulted from ACTH dosing. FIG. 98 shows the percentage change in animal weight by day over the course of the study, and shows that Ab7A.H inhibited ACTH-induced weight loss. FIGS. 99 and 104 respectively show plasma corticosterone and aldosterone levels before ACTH and antibody dosing. FIGS. 100 and 105 respectively show plasma corticosterone and aldosterone levels at 24 hours after initiation of ACTH dosing and before the antibody administration. FIGS. 101 and 106 respectively show plasma corticosterone and aldosterone levels 48 hours after initiation of ACTH dosing and 24 hours after the antibody administration. FIGS. 102 and 107 respectively show plasma corticosterone and aldosterone levels 96 hours after initiation of ACTH dosing and 72 hours after the antibody administration. FIGS. 103 and 108 respectively show plasma corticosterone and aldosterone levels 144 hours after initiation of ACTH dosing and 120 hours after the antibody administration. The results of statistical comparison between treatment groups at the varying time points are as indicated in the figures, and indicate statistically significant decreases in corticosterone caused by Ab7A.H in the ACTH treatment group relative to animals treated with the isotype control, as well as statistically significant increases in corticosterone caused by ACTH dosing relative to vehicle-treated controls.

Overall, FIGS. 98-108 demonstrate that Ab7A.H inhibited ACTH-induced weight loss and ACTH-induced increases in corticosterone and aldosterone levels.

FIGS. 109-112 show the effects of Ab11A.H and Ab15.H on changes in serum corticosterone levels that resulted from ACTH dosing. FIG. 109 shows plasma corticosterone levels before ACTH and antibody dosing. FIG. 110 shows plasma corticosterone levels at 24 hours after initiation of ACTH dosing and before the antibody administration. FIG. 111 shows plasma corticosterone levels 48 hours after initiation of ACTH dosing and 24 hours after the antibody administration. FIG. 112 shows plasma corticosterone levels 96 hours after initiation of ACTH dosing and 72 hours after the antibody administration. The results of statistical comparison between treatment groups at the varying time points are as indicated in the figures, and indicate statistically significant decreases in corticosterone caused by Ab11A.H and Ab15.H in the ACTH treatment group relative to animals treated with the isotype control, as well as statistically significant increases in corticosterone caused by ACTH dosing relative to vehicle-treated controls.

Overall, FIGS. 109-112 demonstrate that Ab11A.H and Ab15.H inhibited ACTH-induced increases in corticosterone levels.

Example 15 Pharmacokinetic Study of Ab13.H in Rats

A pharmacokinetic (PK) study was conducted in male Sprague-Dawley rats surgically implanted with a jugular vein catheter. Four rats were dosed with Ab13.H (5 mg/kg) by IV bolus injection on day 1. Blood samples were collected (into $K_3$EDTA tubes) via the jugular vein catheter prior to antibody dosing, 0.25, 0.5, 1, 2, 8, 12, 24, 48, 96, 144, 192, 312, 384, and 480 hours post dose administration. Whole blood samples were processed to plasma for total antibody level determination. The concentration of total antibody (Ab13.H) in rat plasma was determined using a direct ELISA sandwich format. Briefly, diluted standards, controls, and study samples in 10% rat plasma matrix were incubated with goat anti-Human IgG, which had been immobilized on MSD High Bind microtiter plates. After incubation, unbound material was washed away and Ab13.H was detected with biotinylated goat anti-Human IgG (H+L) and Sulfo-TAG Streptavidin. After washing, diluted 1× Read Buffer was added to each well. Electrochemiluminescence (ECL) signals were measured by MSD SECTOR Imager 2400. Subsequently, ECL signals were collected and analyzed using the MSD Discovery Workbench software. A standard curve was generated using a 4-parameter fit algorithm for each plate. The concentration of total Ab13.H was determined by comparing the ECL signal to the corresponding standard curve. Plasma drug level data underwent pharmacokinetic evaluation using WinNonLin (Professional version 4.1; Pharsight Corporation, Mountain View, Calif.).

Results

FIG. 113 shows total Ab13.H antibody levels determined in each rat. WinNonLin analysis of total antibody levels and computed pharmacokinetic parameters is presented in Table 11.

TABLE 11

WinNonLin analysis of pharmacokinetic parameters for Ab13.H plasma levels in the rat.

| Animal No. | HL_Lambda_z (hr) | Tmax (hr) | Cmax (ug/mL) | AUCINF_pred (hr * ug/mL) | Vz_pred (mL/kg) | Cl_pred (mL/hr/kg) | Vss_pred (mL/kg) |
|---|---|---|---|---|---|---|---|
| 1 | 159.21 | 0.25 | 72.99 | 4654.00 | 246.77 | 1.07 | 221.91 |
| 2 | 169.00 | 0.25 | 68.75 | 4469.27 | 272.77 | 1.12 | 243.62 |
| 3 | 102.82 | 0.50 | 58.42 | 3396.59 | 218.37 | 1.47 | 194.07 |
| 4 | 103.15 | 0.25 | 53.62 | 3251.91 | 228.81 | 1.54 | 212.36 |
| N | 4 | 4 | 4 | 4 | 4 | 4 | 4 |
| Mean | 133.546 | 0.313 | 63.445 | 3942.942 | 241.679 | 1.301 | 217.992 |
| SD | 35.513 | 0.125 | 8.963 | 720.799 | 23.814 | 0.238 | 20.623 |

Example 16 Reduction of Corticosterone Levels in Cynomolgus Monkeys by Ab13.H

A pharmacodynamics (PD) study was conducted in male cynomolgus monkeys. Three cynomolgus monkeys were injected with either Ab13.H or an isotype control antibody (AD26-10) at 10 mg/kg by IV bolus administration on day 1 and day 7. At each time point three blood samples were collected by venipuncture: one sample was processed to serum for clinical chemistry analysis; one sample processed to plasma for cortisol and aldosterone determination; and whole blood was used for CBC analyses. Blood samples were collected day −6 (6 days prior to the first antibody dose), day 3, day 7 (prior to second antibody dose), day 9, day 13, day 17 and day 21. Clinical chemistry analyses included the following parameters: alanine aminotransferase, aspartate aminotransferase, alkaline phosphatase, gamma-glutamyltransferase, lactate dehydrogenase, total bilirubin, urea nitrogen, creatinine, calcium, phosphorus, total protein, albumin, globulin, albumin/globulin ratio, glucose, cholesterol, triglycerides, sodium, potassium, and chloride.

Results: No significant changes were seen in clinical chemistry parameters

Blood draws were taken (into $K_3$EDTA collection tubes) at the same times points as described above from clinical chemistry analyses and the following hematology parameters determined: red blood cell count, hemoglobin concentration, hematocrit, mean corpuscular volume, red blood cell distribution width, mean corpuscular hemoglobin concentration, reticulocyte count, platelet count, white blood cell count, neutrophil count, lymphocyte count, monocyte count, eosinophil count, basophil count, and large unstained cells.

Results: No significant changes were seen in hematology parameters.

Blood draws were taken ($K_3$EDTA) and processed to plasma for cortisol and aldosterone levels determined. Cortisol levels in cynomolgus monkey plasma samples were assessed using a Cortisol EIA kit (R&D) essentially according to the manufacturer's protocol. Briefly 50 ul of a primary antibody was incubated on the plate for 1 hour with shaking, the plate was washed as directed and then 100 μl of plasma samples diluted 1:100, standards, and controls were added to the assay plate, followed by 50 μl of an HRP conjugated cortisol. The assay plate was incubated 2 hours at room temperature with shaking and then washed. It was developed with TMB for 1 hour, then stopped and read at 450 with a 540 nm subtraction.

Results: FIG. 114 demonstrates that Ab13.H reduced cortisol levels in cynomolgus monkeys.

Aldosterone levels in cynomolgus monkey plasma samples were assessed using an aldosterone EIA kit (Enzo Life Sciences) according to the manufacturer's protocol. Briefly 100 μl plasma samples diluted 1:10, standards, and controls were added to the assay plate, followed by 50 μl of an alkaline phosphatase conjugated aldosterone and 50 μl of a polyclonal antibody to aldosterone. The assay plate was incubated 16-24 hours at 4 C and then washed. It was developed with p-Npp for 1 hour, then stopped and read at 405 with a 570 nm subtraction.

Results: FIG. 115 demonstrates that Ab13.H modestly reduced and modulated aldosterone levels in cynomolgus monkeys.

Example 17 Reduction of Corticosterone Levels in Rats by Ab13.H

A pharmacodynamic study was conducted in male Lewis rats. Groups of 8 rats each were injected with either a control isotype antibody (AD26-10) at 10 mg/kg or Ab13.H at 10 mg/kg, 1 mg/kg, 0.1 mg/kg or 0.01 mg/kg. All injections were performed by IV bolus administration on day 0. Two blood samples were collected before test article administration (day −3 and day 0) and 6 blood samples collected post test article administration (day 1, 3, 6, 9, 12 and 15). All blood samples were collected in $K_3$EDTA tubes and processed into plasma for corticosterone analysis.

Corticosterone levels in rat plasma samples were assessed using a Corticosterone EIA kit (Enzo Life Sciences) according to manufacturer's protocol. Briefly, 100 μl plasma samples diluted 1:50, standards and controls were added to assay plate, followed by 50 μl of an alkaline phosphatase conjugated corticosterone and 50 μl of a polyclonal Ab to corticosterone. Assay plates were incubated 2 hours at room temperature with shaking and then washed. Plates were developed with pNpp substrate for 1 hour and read at 405 with a 570 nm subtraction.

The concentration of total antibody (AD26-10 and Ab13.H) in rat plasma was determined using a direct ELISA sandwich format. Briefly, diluted standards, controls, and study samples in 10% rat plasma matrix were incubated with goat anti-Human IgG, which had been immobilized on MSD High Bind microtiter plates. After incubation, unbound material was washed away and Ab13.H was detected with biotinylated goat anti-Human IgG (H+L) and Sulfo-TAG Streptavidin. After washing, diluted 1× Read Buffer was added to each well. Electrochemiluminescence (ECL) signals were measured by MSD SECTOR Imager 2400. Subsequently, ECL signals were collected and analyzed using the MSD Discovery Workbench software. A standard curve was generated using a 4-parameter fit algorithm for each plate. The concentration of total antibody was determined by comparing the ECL signal to the corresponding standard curve.

Results: FIG. 116 shows the corticosterone levels observed in rats dosed with AD26-10 or Ab13.H. Injection of Ab13.H at 10 mg/kg or 1 mg/kg significantly decreased corticosterone levels at all time points post administration ($p<0.05$). Injection of Ab13.H at 0.1 mg/kg significantly decreased corticosterone levels on days 1 and 3 days post administration ($p<0.05$) and then levels were similar to control animals. Administration of Ab13.H at 0.01 mg/kg did not significantly alter corticosterone levels.

FIG. 117 shows the total antibody levels following administration of AD26-10 or Ab13.H. Total antibody levels of AD26-10 and Ab13.H in rats dosed with 10 mg/kg are comparable and Ab13.H dosed at 1 mg/kg, 0.1 mg/kg and 0.01 mg/kg are present at levels consistent with the dose.

Example 18 Reduction of Corticosterone Levels in Rabbits by Ab13.H

A pharmacodynamics study was conducted in male New Zealand White rabbits. On day 1, two groups of five rabbits each were injected with either Ab13.H (50 mg/kg) or vehicle by IV bolus administration. On day 10, the environment of the rabbits was changed from open to the natural environment to a room with an ambient temperature of 20° C. and a 12 hour light/darkness cycle. The rabbits remained in the altered environmental conditions for 31.5 hours and then were returned to the original housing conditions. The change in environment was performed to place stress on the animals which was expected to induce corticosterone via an ACTH-dependent pathway. On day 15, the rabbits were injected IV with 15 g rabbit ACTH (American Peptide). The study was terminated on day 15.

Blood samples were collected on days −7, −3, 2, 3, 7, 10, 11, and 15 (1 hour post ACTH injection) in $K_3$ETDA tubes and processed to plasma for corticosterone analysis. All samples were stored at −70° C. prior to analysis.

Corticosterone levels in rabbit plasma samples were measured using a Corticosterone EIA kit (Enzo Life Sciences) following the manufacturer's instructions. Briefly, 100 µl plasma samples were diluted 1:10, standards and controls were added to assay plate, followed by 50 µl of an alkaline phosphatase conjugated corticosterone and 50 µl of a polyclonal antibody to corticosterone. The assay plate was incubated 2 hours at room temperature with shaking and then washed. It was developed with p-Npp for 1 hour, then stopped and read at 405 with a 570 nm subtraction.

Results: FIG. 118 shows the plasma corticosterone levels in the two groups over the study period. The Ab13.H treatment group exhibited reduced corticosterone levels on days 2, 3 and 7 compared to control rabbits. On days 10 and 11, rabbits were subjected to altered environmental conditions that modestly induced corticosterone levels in the control rabbits, and corticosterone levels in Ab13.H treatment group were slightly induced but to a lesser degree than control animals. On day 15, rabbits were injected with 15 µg rabbit ACTH, which dramatically induced corticosterone in control animals. Corticosterone levels on day 15 in the rabbits in the Ab13.H treatment group were only modestly induced and were significantly lower than control rabbits ($p=0.0079$).

Example 19 Reduction of Corticosterone Levels by Ab13.H in Rats Under Low and High Stress A pharmacodynamics study was conducted in male Lewis rats subjected to blood draws under low and high stress conditions. Low stress blood draws were performed by placing the rats in anesthesia chambers that were lightly heated using heat pads for approximately 5 minutes. Isoflurane was introduced into the chamber for 7-10 minutes and rats were bled after losing consciousness. High stress blood draws were performed by placing the rats in a plexiglass cylinder rat restraint with the rats held at maximum pressure and lightly heated using heat pads for approximately 10 minutes. Rats were then bled without anesthesia via the tail vein using the same rat restrainer. Ab13.H or a control isotype antibody (AD26-10) was administered at 10 mg/kg IV on day 0.

Blood draws were collected on days −5 and −2 prior to antibody administration using the low stress procedure. Blood draws were collected on days 2 and 6 using the low stress procedure and days 3 and 5 using the high stress procedure. Blood draws were collected in $K_3$EDTA tubes and processed to plasma for corticosterone analysis. All samples were stored at −70° C. until analysis.

Corticosterone levels in rat plasma samples were assessed using a Corticosterone EIA kit (Enzo Life Sciences) following the manufacturer's instructions. Briefly, 100 µl plasma samples were diluted 1:20, standards and controls were added to assay plate, followed by 50 µl of an alkaline phosphatase conjugated corticosterone and 50 µl of a polyclonal antibody to corticosterone. The assay plate was incubated 2 hours at room temperature with shaking and then washed. It was developed with p-Npp for 1 hour, then stopped and read at 405 with a 570 nm subtraction.

Results: FIG. 119 shows the plasma corticosterone levels in rats dosed with AD26-10 (square symbols) or Ab13.H (round symbols) and subjected to low or high stress conditions. Administration of Ab13.H reduced corticosterone levels to below the lower limit of quantitation (LLOQ) under the low stress blood draw conditions (days 2 and 6). The high stress blood draw conditions induced corticosterone in the control animals. The induction of corticosterone under the high stress blood draw conditions in the Ab13.H treated rats was measurable but was significantly lower than control rats. In the Ab13.H treatment group, corticosterone levels were statistically significantly reduced on days 2, 3, 5 ($p=0.0002$) and 6 ($p=0.0068$) compared to the control group.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The teachings provided herein of the invention can be applied to other purposes, other than the examples described above.

These and other changes can be made to the invention in light of the above detailed description. In general, in the following claims, the terms used should not be construed to limit the invention to the specific embodiments disclosed in the specification and the claims. Accordingly, the invention is not limited by the disclosure, but instead the scope of the invention is to be determined entirely by the following claims.

The invention may be practiced in ways other than those particularly described in the foregoing description and examples. Numerous modifications and variations of the invention are possible in light of the above teachings and, therefore, are within the scope of the appended claims.

SEQUENCE LISTING (1125 sequences)

SEQ ID NO: 1 - protein, 443 aa, Artificial
  Humanized antibody sequence
QQLEESGGGLVKPGGTLTLTCTASGFSFSSGYDICWARQGPGKGLEWIGCIDTGSGNTYYASWAKGRFTMSRTSSTTVTLQVTSLTAADTATYFCAKGISSIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 113 aa, Artificial
  Humanized antibody sequence
QQLEESGGGLVKPGGTLTLTCTASGFSFSSGYDICWARQGPGKGLEWIGCIDTGSGNTYYASWAKGRFTMSRTSSTTVTLQVTSLTAADTATYFCAKGISSIWGPGTLVTVSS

SEQ ID NO: 3 - protein, 29 aa, Oryctolagus cuniculus
QQLEESGGGLVKPGGTLTLTCTASGFSFS

SEQ ID NO: 4 - protein, 6 aa, Oryctolagus cuniculus
SGYDIC

SEQ ID NO: 5 - protein, 14 aa, Oryctolagus cuniculus
WARQGPGKGLEWIG

SEQ ID NO: 6 - protein, 17 aa, Oryctolagus cuniculus
CIDTGSGNTYYASWAKG

SEQ ID NO: 7 - protein, 31 aa, Oryctolagus cuniculus
RFTMSRTSSTTVTLQVTSLTAADTATYFCAK

SEQ ID NO: 8 - protein, 5 aa, Oryctolagus cuniculus
GISSI

SEQ ID NO: 9 - protein, 11 aa, Artificial
  Humanized antibody sequence
WGPGTLVTVSS

SEQ ID NO: 10 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 1329 bp, Artificial
  Humanized antibody sequence
cagcagctggaggagtccgggggaggcctggtcaagcctggaggaaccctgacactcacctgcacagcctctggattctccttcagtagcggctacgacatctgctgggcccgccagggtccagggaaggggctggagtggatcggatgcattgatactggtagtggtaacacttactacgcgagctgggcgaaaggccgattcaccatgtccagaacctcgtcgaccacggtgactctgcaagtgaccagtctgacagccgcggacacggccacctatttctgtgcgaagggtatttctagtatatggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - DNA, 339 bp, Artificial
  Humanized antibody sequence
cagcagctggaggagtccgggggaggcctggtcaagcctggaggaaccctgacactcacctgcacagcctctggattctccttcagtagcggctacgacatctgctgggcccgccagggtccagggaaggggctggagtggatcggatgcattgatactggtagtggtaacacttactacgcgagctgggcgaaaggccgattcaccatgtccagaacctcgtcgaccacggtgactctgcaagtgaccagtctgacagccgcggacacggccacctatttctgtgcgaagggtatttctagtatatggggcccgggcaccctggtcaccgtctcgagc

SEQ ID NO: 13 - DNA, 87 bp, Oryctolagus cuniculus
cagcagctggaggagtccgggggaggcctggtcaagcctggaggaaccctgacactcacctgcacagcctctggattctccttcagt

SEQ ID NO: 14 - DNA, 18 bp, Oryctolagus cuniculus
agcggctacgacatctgc

SEQ ID NO: 15 - DNA, 42 bp, Oryctolagus cuniculus
tgggcccgccagggtccagggaaggggctggagtggatcgga

SEQ ID NO: 16 - DNA, 51 bp, Oryctolagus cuniculus
tgcattgatactggtagtggtaacacttactacgcgagctgggcgaaaggc

SEQ ID NO: 17 - DNA, 93 bp, Oryctolagus cuniculus
cgattcaccatgtccagaacctcgtcgaccacggtgactctgcaagtgaccagtctgacagccgcggacacggccacctatttctgtgcgaag

SEQ ID NO: 18 - DNA, 15 bp, Oryctolagus cuniculus
ggtatttctagtata

SEQ ID NO: 19 - DNA, 33 bp, Artificial
  Humanized antibody sequence
tggggcccgggcaccctggtcaccgtctcgagc

SEQ ID NO: 20 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - protein, 217 aa, Artificial
  Humanized antibody sequence
DIVMTQTPASVSEPVGGTVTIKCQASQTISSDLAWYQQKPGQPPKLLIYAASKLTSGVSSRFKGGGTGTQFTLTISDLECADAATYYCQTYYDIIDDGCTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 111 aa, Artificial
  Humanized antibody sequence
DIVMTQTPASVSEPVGGTVTIKCQASQTISSDLAWYQQKPGQPPKLLIYAASKLTSGVSSRFKGGGTGTQFTLTISDLECADAATYYCQTYYDIIDDGCTFGGGTEVVVKR

SEQ ID NO: 23 - protein, 23 aa, Oryctolagus cuniculus
DIVMTQTPASVSEPVGGTVTIKC

SEQ ID NO: 24 - protein, 11 aa, Oryctolagus cuniculus
QASQTISSDLA

SEQ ID NO: 25 - protein, 15 aa, Oryctolagus cuniculus
WYQQKPGQPPKLLIY

SEQ ID NO: 26 - protein, 7 aa, Oryctolagus cuniculus
AASKLTS

SEQ ID NO: 27 - protein, 32 aa, Oryctolagus cuniculus
GVSSRFKGGGTGTQFTLTISDLECADAATYYC

SEQ ID NO: 28 - protein, 12 aa, Oryctolagus cuniculus
QTYYDIIDDGCT

SEQ ID NO: 29 - protein, 11 aa, Artificial
  Humanized antibody sequence
FGGGTEVVVKR

SEQ ID NO: 30 - protein, 106 aa, Artificial
  Humanized antibody sequence
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - DNA, 651 bp, Artificial
  Humanized antibody sequence
gatattgtgatgacccagactccagcctccgtgtctgaacctgtgggaggcacagtcaccatcaagtgccaggccagtcagaccattagtagcgacttagcctggtatcagcagaaaccagggcagcctcccaagctcctgatctatgctgcatccaagctgacatctggggtctcatcgcgcttcaaaggcggtggaactgggacacagttcactctcaccatcagcgacctggagtgtgccgatgctgccacttactactgtcaaacatattatgatattattgatgatggttgtactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 32 - DNA, 333 bp, Artificial
  Humanized antibody sequence
gatattgtgatgacccagactccagcctccgtgtctgaacctgtgggaggcacagtcaccatcaagtgccaggccagtcagaccattagtagcgacttagcctggtatcagcagaaaccagggcagcctcccaagctcctgatctatgctgcatccaagctgacatctggggtctcatcgcgcttcaaaggcggtggaactgggacacagttcactctcaccatcagcgacctggagtgtgccgatgctgccacttactactgtcaaacatattatgatattattgatgatggttgtactttcggcggagggaccgaggtggtggtcaaacgt

SEQ ID NO: 33 - DNA, 69 bp, Oryctolagus cuniculus
gatattgtgatgacccagactccagcctccgtgtctgaacctgtgggaggcacagtcaccatcaagtgc

SEQ ID NO: 34 - DNA, 33 bp, Oryctolagus cuniculus
caggccagtcagaccattagtagcgacttagcc

SEQ ID NO: 35 - DNA, 45 bp, Oryctolagus cuniculus
tggtatcagcagaaaccagggcagcctcccaagctcctgatctat

SEQ ID NO: 36 - DNA, 21 bp, Oryctolagus cuniculus
gctgcatccaagctgacatct

SEQ ID NO: 37 - DNA, 96 bp, Oryctolagus cuniculus
ggggtctcatcgcgcttcaaaggcggtggaactgggacacagttcactctcaccatcagcgacctggagtgtgccgatgctgccacttactactgt

SEQ ID NO: 38 - DNA, 36 bp, Oryctolagus cuniculus
caaacatattatgatattattgatgatggttgtact

SEQ ID NO: 39 - DNA, 33 bp, Artificial
  Humanized antibody sequence
ttcggcggagggaccgaggtggtggtcaaacgt

SEQ ID NO: 40 - DNA, 318 bp, Artificial
  Humanized antibody sequence
acggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 41 - protein, 444 aa, Artificial
  Humanized antibody sequence
QQQLEESGGGLVKPGGTLTLTCKGSGIAFSDTYDMCWVRQAPGKGLEWIGCIDTGSGDTYYPTWAKGRFTISKPSSTTVDLKMTSLTAADTATYFCAKGVSSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 114 aa, Artificial
  Humanized antibody sequence
QQQLEESGGGLVKPGGTLTLTCKGSGIAFSDTYDMCWVRQAPGKGLEWIGCIDTGSGDTYYPTWAKGRFTISKPSSTTVDLKMTSLTAADTATYFCAKGVSSLWGQGTLVTVSS

SEQ ID NO: 43 - protein, 30 aa, Oryctolagus cuniculus
QQQLEESGGGLVKPGGTLTLTCKGSGIAFS

SEQ ID NO: 44 - protein, 6 aa, Oryctolagus cuniculus
DTYDMC

SEQ ID NO: 45 - protein, 14 aa, Oryctolagus cuniculus
WVRQAPGKGLEWIG

SEQ ID NO: 46 - protein, 17 aa, Oryctolagus cuniculus
CIDTGSGDTYYPTWAKG

SEQ ID NO: 47 - protein, 31 aa, Oryctolagus cuniculus
RFTISKPSSTTVDLKMTSLTAADTATYFCAK

SEQ ID NO: 48 - protein, 5 aa, Oryctolagus cuniculus
GVSSL

SEQ ID NO: 49 - protein, 11 aa, Artificial
  Humanized antibody sequence
WGQGTLVTVSS

SEQ ID NO: 50 - protein, 330 aa, Artificial; identical to SEQ ID NO: 10
  Humanized antibody sequence

SEQ ID NO: 51 - DNA, 1332 bp, Artificial
  Humanized antibody sequence
cagcagcaactggaagagtccgggggaggcctagtcaagcctggaggaaccctgacactcacctgtaaaggctctggaattgccttcagtgacacctacgacatgtgctgggtccgccaggctccggggaaggggctggaatggatcggatgcatcgatactggtagtggtgacacttactacccgacctgggcgaaaggccgattcaccatctccaaaccctcgtcgaccacggtggatctgaaaatgaccagtctgacagccgcggacacggccacatatttctgtgcgaagggtgtttccagtttatggggccaggggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - DNA, 342 bp, Artificial
  Humanized antibody sequence
cagcagcaactggaagagtccgggggaggcctagtcaagcctggaggaaccctgacactcacctgtaaaggctctggaattgccttcagtgacacctacgacatgtgctgggtccgccaggctccggggaaggggctggaatggatcggatgcatcgatactggtagtggtgacacttactacccgacctgggcgaaaggccgattcaccatctccaaaccctcgtcgaccacggtggatctgaaaatgaccagtctgacagccgcggacacggccacatatttctgtgcgaagggtgtttccagtttatggggccaggggaccctcgtcaccgtctcgagc

SEQ ID NO: 53 - DNA, 90 bp, Oryctolagus cuniculus
cagcagcaactggaagagtccgggggaggcctagtcaagcctggaggaaccctgacactcacctgtaaaggctctggaattgccttcagt

SEQ ID NO: 54 - DNA, 18 bp, Oryctolagus cuniculus
gacacctacgacatgtgc

SEQ ID NO: 55 - DNA, 42 bp, Oryctolagus cuniculus
tgggtccgccaggctccggggaaggggctggaatggatcgga

SEQ ID NO: 56 - DNA, 51 bp, Oryctolagus cuniculus
tgcatcgatactggtagtggtgacacttactacccgacctgggcgaaaggc

SEQ ID NO: 57 - DNA, 93 bp, Oryctolagus cuniculus
cgattcaccatctccaaaccctcgtcgaccacggtggatctgaaaatgaccagtctgacagccgcggacacggccacatatttctgtgcgaag

SEQ ID NO: 58 - DNA, 15 bp, Oryctolagus cuniculus
ggtgtttccagttta

SEQ ID NO: 59 - DNA, 33 bp, Artificial
  Humanized antibody sequence
tggggccaggggaccctcgtcaccgtctcgagc

SEQ ID NO: 60 - DNA, 990 bp, Artificial; identical to SEQ ID NO: 20
  Humanized antibody sequence

SEQ ID NO: 61 - protein, 217 aa, Artificial
  Humanized antibody sequence
DIVMTQTPASVSEPVGGTVTIKCQASEDIESDLAWYQQKPGQPPKLLIYGASTLKSGVSSRFRGSGSGTEYTLTISDLECADAATYYCQTYYDMADDGCSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 111 aa, Artificial
  Humanized antibody sequence
DIVMTQTPASVSEPVGGTVTIKCQASEDIESDLAWYQQKPGQPPKLLIYGASTLKSGVSSRFRGSGSGTEYTLTISDLECADAATYYCQTYYDMADDGCSFGGGTEVVVKR

SEQ ID NO: 63 - protein, 23 aa, Oryctolagus cuniculus
DIVMTQTPASVSEPVGGTVTIKC

SEQ ID NO: 64 - protein, 11 aa, Oryctolagus cuniculus
QASEDIESDLA

SEQ ID NO: 65 - protein, 15 aa, Oryctolagus cuniculus
WYQQKPGQPPKLLIY

SEQ ID NO: 66 - protein, 7 aa, Oryctolagus cuniculus
GASTLKS

SEQ ID NO: 67 - protein, 32 aa, Oryctolagus cuniculus
GVSSRFRGSGSGTEYTLTISDLECADAATYYC

SEQ ID NO: 68 - protein, 12 aa, Oryctolagus cuniculus
QTYYDMADDGCS

SEQ ID NO: 69 - protein, 11 aa, Artificial
  Humanized antibody sequence
FGGGTEVVVKR

SEQ ID NO: 70 - protein, 106 aa, Artificial; identical to SEQ ID NO: 30
  Humanized antibody sequence

SEQ ID NO: 71 - DNA, 651 bp, Artificial
  Humanized antibody sequence
gacatcgtgatgacccagactccagcctccgtgtctgaacctgtgggaggcacagtcaccatcaagtgccaggccagtgaggacattgaaagcgatttagcctggtatcagcagaaaccagggcagcctcccaagctcctgatctatggtgcatccactctgaagtctggggtctcatcaaggttcagaggcagtggatctgggacagagtacactctcaccatcagcgacctggagtgtgccgatgctgccacttactactgtcaaacctattatgatatggctgatgatggttgtagtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 72 - DNA, 333 bp, Artificial
  Humanized antibody sequence
gacatcgtgatgacccagactccagcctccgtgtctgaacctgtgggaggcacagtcaccatcaagtgccaggccagtgaggacattgaaagcgatttagcctggtatcagcagaaaccagggcagcctcccaagctcctgatctatggtgcatccactctgaagtctggggtctcatcaaggttcagaggcagtggatctgggacagagtacactctcaccatcagcgacctggagtgtgccgatgctgccacttactactgtcaaacctattatgatatggctgatgatggttgtagtttcggcggagggaccgaggtggtggtcaaacgt

SEQ ID NO: 73 - DNA, 69 bp, Oryctolagus cuniculus
gacatcgtgatgacccagactccagcctccgtgtctgaacctgtgggaggcacagtcaccatcaagtgc

SEQ ID NO: 74 - DNA, 33 bp, Oryctolagus cuniculus
caggccagtgaggacattgaaagcgatttagcc

SEQ ID NO: 75 - DNA, 45 bp, Oryctolagus cuniculus; identical to SEQ ID NO: 35

SEQ ID NO: 76 - DNA, 21 bp, Oryctolagus cuniculus
ggtgcatccactctgaagtct

SEQ ID NO: 77 - DNA, 96 bp, Oryctolagus cuniculus
ggggtctcatcaaggttcagaggcagtggatctgggacagagtacactctcaccatcagcgacctggagtgtgccgatgctgccacttactactgt

SEQ ID NO: 78 - DNA, 36 bp, Oryctolagus cuniculus
caaacctattatgatatggctgatgatggttgtagt

SEQ ID NO: 79 - DNA, 33 bp, Artificial; identical to SEQ ID NO: 39
  Humanized antibody sequence

SEQ ID NO: 80 - DNA, 318 bp, Artificial; identical to SEQ ID NO: 40
  Humanized antibody sequence

SEQ ID NO: 81 - protein, 444 aa, Artificial
  Humanized antibody sequence
QQQLEESGGGLVKPGGTLTLTCKASGFSFSSGYDICWARQGPGKGLEWIGCIDTGSGNTYYASWAKGRFTISRTSSTTVTLQMTSLTAADTATYFCAKGISSLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 114 aa, Artificial
  Humanized antibody sequence
QQQLEESGGGLVKPGGTLTLTCKASGFSFSSGYDICWARQGPGKGLEWIGCIDTGSGNTYYASWAKGRFTISRTSSTTVTLQMTSLTAADTATYFCAKGISSLWGPGTLVTVSS

SEQ ID NO: 83 - protein, 30 aa, Oryctolagus cuniculus
QQQLEESGGGLVKPGGTLTLTCKASGFSFS

SEQ ID NO: 84 - protein, 6 aa, Oryctolagus cuniculus
SGYDIC

SEQ ID NO: 85 - protein, 14 aa, Oryctolagus cuniculus
WARQGPGKGLEWIG

SEQ ID NO: 86 - protein, 17 aa, Oryctolagus cuniculus
CIDTGSGNTYYASWAKG

SEQ ID NO: 87 - protein, 31 aa, Oryctolagus cuniculus
RFTISRTSSTTVTLQMTSLTAADTATYFCAK

SEQ ID NO: 88 - protein, 5 aa, Oryctolagus cuniculus
GISSL

SEQ ID NO: 89 - protein, 11 aa, Artificial
  Humanized antibody sequence
WGPGTLVTVSS

SEQ ID NO: 90 - protein, 330 aa, Artificial; identical to SEQ ID NO: 10
  Humanized antibody sequence

SEQ ID NO: 91 - DNA, 1332 bp, Artificial
  Humanized antibody sequence
cagcagcagctggaggagtccgggggaggcctggtcaagcctggaggaaccctgacactcacctgcaaagcctctggattctccttcagtagcggctacgacatctgctgggcccgccagggtccagggaaggggctggagtggatcggatgcattgatactggtagtggtaacacttactacgcgagctgggcgaaaggccgattcaccatctccagaacctcgtcgaccacggtgactctgcaaatgaccagtctgacagccgcggacacggccacctatttctgtgcgaagggtatttctagtttatggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - DNA, 342 bp, Artificial
  Humanized antibody sequence
cagcagcagctggaggagtccgggggaggcctggtcaagcctggaggaaccctgacactcacctgcaaagcctctggattctccttcagtagcggctacgacatctgctgggcccgccagggtccagggaaggggctggagtggatcggatgcattgatactggtagtggtaacacttactacgcgagctgggcgaaaggccgattcaccatctccagaacctcgtcgaccacggtgactctgcaaatgaccagtctgacagccgcggacacggccacctatttctgtgcgaagggtatttctagtttatggggcccgggcaccctggtcaccgtctcgagc

SEQ ID NO: 93 - DNA, 90 bp, Oryctolagus cuniculus
cagcagcagctggaggagtccgggggaggcctggtcaagcctggaggaaccctgacactcacctgcaaagcctctggattctccttcagt

SEQ ID NO: 94 - DNA, 18 bp, Oryctolagus cuniculus
agcggctacgacatctgc

SEQ ID NO: 95 - DNA, 42 bp, Oryctolagus cuniculus; identical to SEQ ID NO: 15

SEQ ID NO: 96 - DNA, 51 bp, Oryctolagus cuniculus; identical to SEQ ID NO: 16

SEQ ID NO: 97 - DNA, 93 bp, Oryctolagus cuniculus
cgattcaccatctccagaacctcgtcgaccacggtgactctgcaaatgaccagtctgacagccgcggacacggccacctatttctgtgcgaag

SEQ ID NO: 98 - DNA, 15 bp, Oryctolagus cuniculus
ggtatttctagttta

SEQ ID NO: 99 - DNA, 33 bp, Artificial; identical to SEQ ID NO: 19
  Humanized antibody sequence

SEQ ID NO: 100 - DNA, 990 bp, Artificial; identical to SEQ ID NO: 20
  Humanized antibody sequence

SEQ ID NO: 101 - protein, 217 aa, Artificial
  Humanized antibody sequence
DIVMTQTPASVSEPVGGTVTIKCQASQTISSDLAWYQQKPGQPPKLLIYAASKLTSGVSSRFKGGGTGTQFTLTISDLECADAATYYCQTYYDISDDGCTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 111 aa, Artificial
  Humanized antibody sequence
DIVMTQTPASVSEPVGGTVTIKCQASQTISSDLAWYQQKPGQPPKLLIYAASKLTSGVSSRFKGGGTGTQFTLTISDLECADAATYYCQTYYDISDDGCTFGGGTEVVVKR

SEQ ID NO: 103 - protein, 23 aa, Oryctolagus cuniculus
DIVMTQTPASVSEPVGGTVTIKC

SEQ ID NO: 104 - protein, 11 aa, Oryctolagus cuniculus
QASQTISSDLA

SEQ ID NO: 105 - protein, 15 aa, Oryctolagus cuniculus
WYQQKPGQPPKLLIY

SEQ ID NO: 106 - protein, 7 aa, Oryctolagus cuniculus
AASKLTS

SEQ ID NO: 107 - protein, 32 aa, Oryctolagus cuniculus; identical to SEQ ID NO: 27

SEQ ID NO: 108 - protein, 12 aa, Oryctolagus cuniculus
QTYYDISDDGCT

SEQ ID NO: 109 - protein, 11 aa, Artificial
  Humanized antibody sequence
FGGGTEVVVKR

SEQ ID NO: 110 - protein, 106 aa, Artificial; identical to SEQ ID NO: 30
  Humanized antibody sequence

SEQ ID NO: 111 - DNA, 651 bp, Artificial
  Humanized antibody sequence
gatattgtgatgacccagactccagcctccgtgtctgaacctgtgggaggcacagtcaccatcaagtgccaggccagtcagaccattagtagcgacttagcctggtatcagcagaaaccagggcagcctcccaagctcctgatctatgctgcatccaaactgacatctggggtctcatcgcggttcaaaggcggtggaactgggacacagttcactctcaccatcagcgacctggagtgtgccgatgctgccacttactactgtcaaacctattatgatattagtgatgatggttgtactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 112 - DNA, 333 bp, Artificial
  Humanized antibody sequence
gatattgtgatgacccagactccagcctccgtgtctgaacctgtgggaggcacagtcaccatcaagtgccaggccagtcagaccattagtagcgacttagcctggtatcagcagaaaccagggcagcctcccaagctcctgatctatgctgcatccaaactgacatctggggtctcatcgcggttcaaaggcggtggaactgggacacagttcactctcaccatcagcgacctggagtgtgccgatgctgccacttactactgtcaaacctattatgatattagtgatgatggttgtactttcggcggagggaccgaggtggtggtcaaacgt

SEQ ID NO: 113 - DNA, 69 bp, Oryctolagus cuniculus; identical to SEQ ID NO: 33

SEQ ID NO: 114 - DNA, 33 bp, Oryctolagus cuniculus; identical to SEQ ID NO: 34

SEQ ID NO: 115 - DNA, 45 bp, Oryctolagus cuniculus; identical to SEQ ID NO: 35

SEQ ID NO: 116 - DNA, 21 bp, Oryctolagus cuniculus
gctgcatccaaactgacatct

SEQ ID NO: 117 - DNA, 96 bp, Oryctolagus cuniculus
ggggtctcatcgcggttcaaaggcggtggaactgggacacagttcactctcaccatcagcgacctggagtgtgccgatgctgccacttactactgt

SEQ ID NO: 118 - DNA, 36 bp, Oryctolagus cuniculus
caaacctattatgatattagtgatgatggttgtact

SEQ ID NO: 119 - DNA, 33 bp, Artificial; identical to SEQ ID NO: 39
  Humanized antibody sequence

SEQ ID NO: 120 - DNA, 318 bp, Artificial; identical to SEQ ID NO: 40
  Humanized antibody sequence

SEQ ID NO: 121 - protein, 443 aa, Artificial
  Humanized antibody sequence
EVQLVESGGGLVQPGGSLRLSCAASGFTVSNYDMIWVRQAPGKGLESIGMIYDDGDTYYASSAKGRFTISRDNSKNTLYLQMNSLRAEDTAVYYCVKGVSNHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 113 aa, Artificial
  Humanized antibody sequence
EVQLVESGGGLVQPGGSLRLSCAASGFTVSNYDMIWVRQAPGKGLESIGMIYDDGDTYYASSAKGRFTISRDNSKNTLYLQMNSLRAEDTAVYYCVKGVSNHWGQGTLVTVSS

SEQ ID NO: 123 - protein, 30 aa, Artificial
  Humanized antibody sequence
EVQLVESGGGLVQPGGSLRLSCAASGFTVS

SEQ ID NO: 124 - protein, 5 aa, Artificial
  Humanized antibody sequence
NYDMI

SEQ ID NO: 125 - protein, 14 aa, Artificial
  Humanized antibody sequence
WVRQAPGKGLESIG

SEQ ID NO: 126 - protein, 16 aa, Artificial
  Humanized antibody sequence
MIYDDGDTYYASSAKG

SEQ ID NO: 127 - protein, 32 aa, Artificial
  Humanized antibody sequence
RFTISRDNSKNTLYLQMNSLRAEDTAVYYCVK

SEQ ID NO: 128 - protein, 5 aa, Artificial
  Humanized antibody sequence
GVSNH

SEQ ID NO: 129 - protein, 11 aa, Artificial
  Humanized antibody sequence
WGQGTLVTVSS

SEQ ID NO: 130 - protein, 330 aa, Artificial; identical to SEQ ID NO: 10
  Humanized antibody sequence

SEQ ID NO: 131 - DNA, 1329 bp, Artificial
  Humanized antibody sequence
gaggtgcagcttgtggagtctgggggaggcttggtccagcctggggggtccctgagactctcctgtgcagcctctggattcaccgtcagtaactatgacatgatctgggtccgtcaggctccagggaaggggctggagtccatcggaatgatttatgatgatggtgacacatactacgctagttctgctaaaggccgattcaccatctccagagacaattccaagaacaccctgtatcttcaaatgaacagcctgagagctgaggacactgctgtgtattactgtgtcaaaggtgtgagtaatcactggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 339 bp, Artificial
  Humanized antibody sequence
gaggtgcagcttgtggagtctgggggaggcttggtccagcctggggggtccctgagactctcctgtgcagcctctggattcaccgtcagtaactatgacatgatctgggtccgtcaggctccagggaaggggctggagtccatcggaatgatttatgatgatggtgacacatactacgctagttctgctaaaggccgattcaccatctccagagacaattccaagaacaccctgtatcttcaaatgaacagcctgagagctgaggacactgctgtgtattactgtgtcaaaggtgtgagtaatcactggggccaagggaccctcgtcaccgtctcgagc

SEQ ID NO: 133 - DNA, 90 bp, Artificial
  Humanized antibody sequence
gaggtgcagcttgtggagtctgggggaggcttggtccagcctggggggtccctgagactctcctgtgcagcctctggattcaccgtcagt

SEQ ID NO: 134 - DNA, 15 bp, Artificial
  Humanized antibody sequence
aactatgacatgatc

SEQ ID NO: 135 - DNA, 42 bp, Artificial
  Humanized antibody sequence
tgggtccgtcaggctccagggaaggggctggagtccatcgga

SEQ ID NO: 136 - DNA, 48 bp, Artificial
  Humanized antibody sequence
atgatttatgatgatggtgacacatactacgctagttctgctaaaggc

SEQ ID NO: 137 - DNA, 96 bp, Artificial
  Humanized antibody sequence
cgattcaccatctccagagacaattccaagaacaccctgtatcttcaaatgaacagcctgagagctgaggacactgctgtgtattactgtgtcaaa

SEQ ID NO: 138 - DNA, 15 bp, Artificial
  Humanized antibody sequence
ggtgtgagtaatcac

SEQ ID NO: 139 - DNA, 33 bp, Artificial
  Humanized antibody sequence
tggggccaagggaccctcgtcaccgtctcgagc

SEQ ID NO: 140 - DNA, 990 bp, Artificial; identical to SEQ ID NO: 20
  Humanized antibody sequence

SEQ ID NO: 141 - protein, 219 aa, Artificial
  Humanized antibody sequence
DIQMTQSPSTLSASVGDRVTITCQASQSISSYLAWYQQKPGKAPKLLIYSASTLASGVPSRFSGSGSGTEFTLTISSLQPDDFATYYCQSYDGSSGSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 113 aa, Artificial
  Humanized antibody sequence
DIQMTQSPSTLSASVGDRVTITCQASQSISSYLAWYQQKPGKAPKLLIYSASTLASGVPSRFSGSGSGTEFTLTISSLQPDDFATYYCQSYDGSSGSSYGVGFGGGTKVEIKR

SEQ ID NO: 143 - protein, 23 aa, Artificial
  Humanized antibody sequence
DIQMTQSPSTLSASVGDRVTITC

SEQ ID NO: 144 - protein, 11 aa, Artificial
  Humanized antibody sequence
QASQSISSYLA

SEQ ID NO: 145 - protein, 15 aa, Artificial
  Humanized antibody sequence
WYQQKPGKAPKLLIY

SEQ ID NO: 146 - protein, 7 aa, Artificial
  Humanized antibody sequence
SASTLAS

SEQ ID NO: 147 - protein, 32 aa, Artificial
  Humanized antibody sequence
GVPSRFSGSGSGTEFTLTISSLQPDDFATYYC

SEQ ID NO: 148 - protein, 14 aa, Artificial
  Humanized antibody sequence
QSYDGSSGSSYGVG

SEQ ID NO: 149 - protein, 11 aa, Artificial
  Humanized antibody sequence
FGGGTKVEIKR

SEQ ID NO: 150 - protein, 106 aa, Artificial; identical to SEQ ID NO: 30
  Humanized antibody sequence

SEQ ID NO: 151 - DNA, 657 bp, Artificial
  Humanized antibody sequence
gacatccagatgacccagtctccttccaccctgtctgcatctgtaggagacagagtcaccatcacttgtcaggccagtcagagcattagtagttacttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtggtagtagttatggtgttggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 152 - DNA, 339 bp, Artificial
  Humanized antibody sequence
gacatccagatgacccagtctccttccaccctgtctgcatctgtaggagacagagtcaccatcacttgtcaggccagtcagagcattagtagttacttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtggtagtagttatggtgttggtttcggcggaggaaccaaggtggaaatcaaacgt

SEQ ID NO: 153 - DNA, 69 bp, Artificial
  Humanized antibody sequence
gacatccagatgacccagtctccttccaccctgtctgcatctgtaggagacagagtcaccatcacttgt

SEQ ID NO: 154 - DNA, 33 bp, Artificial
  Humanized antibody sequence
caggccagtcagagcattagtagttacttagcc

SEQ ID NO: 155 - DNA, 45 bp, Artificial
  Humanized antibody sequence
tggtatcagcagaaaccaggaaaagcccctaagctcctgatctat

SEQ ID NO: 156 - DNA, 21 bp, Artificial
  Humanized antibody sequence
tctgcatccactctggcatct

SEQ ID NO: 157 - DNA, 96 bp, Artificial
  Humanized antibody sequence
ggagtcccatcaaggttcagcggcagtggatctggaacagaattcactctcaccatcagcagcctgcagcctgatgattttgcaacttactactgt

SEQ ID NO: 158 - DNA, 42 bp, Artificial
  Humanized antibody sequence
caaagctatgatggtagtagtggtagtagttatggtgttggt

SEQ ID NO: 159 - DNA, 33 bp, Artificial
  Humanized antibody sequence
ttcggcggaggaaccaaggtggaaatcaaacgt

SEQ ID NO: 160 - DNA, 318 bp, Artificial
  Humanized antibody sequence
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 161 - protein, 443 aa, Artificial
  Humanized antibody sequence
EVQLVESGGGLVQPGGSLRLSCAASGFTVSKYDMIWVRQAPGKGLESIGIIYDDGDTYYASSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 113 aa, Artificial
  Humanized antibody sequence
EVQLVESGGGLVQPGGSLRLSCAASGFTVSKYDMIWVRQAPGKGLESIGIIYDDGDTYYASSAKGRFTISRDNSKNTLYLQMNSLRAEDTAVYYCVKGVSNIWGQGTLVTVSS

SEQ ID NO: 163 - protein, 30 aa, Artificial; identical to SEQ ID NO: 123
  Humanized antibody sequence

SEQ ID NO: 164 - protein, 5 aa, Artificial
  Humanized antibody sequence
KYDMI

SEQ ID NO: 165 - protein, 14 aa, Artificial
  Humanized antibody sequence
WVRQAPGKGLESIG

SEQ ID NO: 166 - protein, 16 aa, Artificial
  Humanized antibody sequence
IIYDDGDTYYASSAKG

SEQ ID NO: 167 - protein, 32 aa, Artificial; identical to SEQ ID NO: 127
  Humanized antibody sequence

SEQ ID NO: 168 - protein, 5 aa, Artificial
  Humanized antibody sequence
GVSNI

SEQ ID NO: 169 - protein, 11 aa, Artificial
  Humanized antibody sequence
WGQGTLVTVSS

SEQ ID NO: 170 - protein, 330 aa, Artificial; identical to SEQ ID NO: 10
  Humanized antibody sequence

SEQ ID NO: 171 - DNA, 1329 bp, Artificial
  Humanized antibody sequence
gaggtgcagcttgtggagtctgggggaggcttggtccagcctggggggtccctgagactctcctgtgcagcctctggattcaccgtcagtaagtatgacatgatctgggtccgtcaggctccagggaaggggctggagtccatcggaatcatttatgatgatggcgacacatattacgctagttctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - DNA, 339 bp, Artificial
  Humanized antibody sequence
gaggtgcagcttgtggagtctgggggaggcttggtccagcctggggggtccctgagactctcctgtgcagcctctggattcaccgtcagtaagtatgacatgatctgggtccgtcaggctccagggaaggggctggagtccatcggaatcatttatgatgatggcgacacatattacgctagttctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagc

SEQ ID NO: 173 - DNA, 90 bp, Artificial; identical to SEQ ID NO: 133
  Humanized antibody sequence

SEQ ID NO: 174 - DNA, 15 bp, Artificial
  Humanized antibody sequence
aagtatgacatgatc

SEQ ID NO: 175 - DNA, 42 bp, Artificial; identical to SEQ ID NO: 135
  Humanized antibody sequence

SEQ ID NO: 176 - DNA, 48 bp, Artificial
  Humanized antibody sequence
atcatttatgatgatggcgacacatattacgctagttctgctaaaggc

SEQ ID NO: 177 - DNA, 96 bp, Artificial; identical to SEQ ID NO: 137
  Humanized antibody sequence

SEQ ID NO: 178 - DNA, 15 bp, Artificial
  Humanized antibody sequence
ggtgtgagtaatatc

SEQ ID NO: 179 - DNA, 33 bp, Artificial; identical to SEQ ID NO: 139
  Humanized antibody sequence

SEQ ID NO: 180 - DNA, 990 bp, Artificial; identical to SEQ ID NO: 20
  Humanized antibody sequence

SEQ ID NO: 181 - protein, 219 aa, Artificial
  Humanized antibody sequence
DIQMTQSPSTLSASVGDRVTITCQASQSISNYLAWYQQKPGKAPKLLIYSASTLASGVPSRFSGSGSGTEFTLTISSLQPDDFATYYCQSYEGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 113 aa, Artificial
  Humanized antibody sequence
DIQMTQSPSTLSASVGDRVTITCQASQSISNYLAWYQQKPGKAPKLLIYSASTLASGVPSRFSGSGSGTEFTLTISSLQPDDFATYYCQSYEGSSSSSYGVGFGGGTKVEIKR

SEQ ID NO: 183 - protein, 23 aa, Artificial
  Humanized antibody sequence
DIQMTQSPSTLSASVGDRVTITC

SEQ ID NO: 184 - protein, 11 aa, Artificial
  Humanized antibody sequence
QASQSISNYLA

SEQ ID NO: 185 - protein, 15 aa, Artificial
  Humanized antibody sequence
WYQQKPGKAPKLLIY

SEQ ID NO: 186 - protein, 7 aa, Artificial
  Humanized antibody sequence
SASTLAS

SEQ ID NO: 187 - protein, 32 aa, Artificial; identical to SEQ ID NO: 147
  Humanized antibody sequence

SEQ ID NO: 188 - protein, 14 aa, Artificial
  Humanized antibody sequence
QSYEGSSSSSYGVG

SEQ ID NO: 189 - protein, 11 aa, Artificial
  Humanized antibody sequence
FGGGTKVEIKR

SEQ ID NO: 190 - protein, 106 aa, Artificial; identical to SEQ ID NO: 30
  Humanized antibody sequence

SEQ ID NO: 191 - DNA, 657 bp, Artificial
  Humanized antibody sequence
gacatccagatgacccagtctccttccaccctgtctgcatctgtaggagacagagtcaccatcacttgtcaggccagtcagagcattagtaactacttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgagggtagtagtagtagtagttatggtgttggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - DNA, 339 bp, Artificial
  Humanized antibody sequence
gacatccagatgacccagtctccttccaccctgtctgcatctgtaggagacagagtcaccatcacttgtcaggccagtcagagcattagtaactacttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgagggtagtagtagtagtagttatggtgttggtttcggcggaggaaccaaggtggaaatcaaacgt

SEQ ID NO: 193 - DNA, 69 bp, Artificial; identical to SEQ ID NO: 153
  Humanized antibody sequence

SEQ ID NO: 194 - DNA, 33 bp, Artificial
  Humanized antibody sequence
caggccagtcagagcattagtaactacttagcc

SEQ ID NO: 195 - DNA, 45 bp, Artificial; identical to SEQ ID NO: 155
  Humanized antibody sequence

SEQ ID NO: 196 - DNA, 21 bp, Artificial
  Humanized antibody sequence
tctgcatccactctggcatct

SEQ ID NO: 197 - DNA, 96 bp, Artificial; identical to SEQ ID NO: 157
  Humanized antibody sequence

SEQ ID NO: 198 - DNA, 42 bp, Artificial
  Humanized antibody sequence
caaagctatgagggtagtagtagtagtagttatggtgttggt

SEQ ID NO: 199 - DNA, 33 bp, Artificial; identical to SEQ ID NO: 159
  Humanized antibody sequence

SEQ ID NO: 200 - DNA, 318 bp, Artificial; identical to SEQ ID NO: 160
  Humanized antibody sequence

SEQ ID NO: 201 - protein, 443 aa, Artificial
  Humanized antibody sequence
EVQLVESGGGLVQPGGSLRLSCAASGSSLSNFDMIWVRQAPGKGLESIGIIYDFGSTYYASSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 113 aa, Artificial
  Humanized antibody sequence
EVQLVESGGGLVQPGGSLRLSCAASGSSLSNFDMIWVRQAPGKGLESIGIIYDFGSTYYASSAKGRFTISRDNSKNTLYLQMNSLRAEDTAVYYCVKGVSNIWGQGTLVTVSS

SEQ ID NO: 203 - protein, 30 aa, Artificial
  Humanized antibody sequence
EVQLVESGGGLVQPGGSLRLSCAASGSSLS

SEQ ID NO: 204 - protein, 5 aa, Artificial
  Humanized antibody sequence
NFDMI

SEQ ID NO: 205 - protein, 14 aa, Artificial
  Humanized antibody sequence
WVRQAPGKGLESIG

SEQ ID NO: 206 - protein, 16 aa, Artificial
  Humanized antibody sequence
IIYDFGSTYYASSAKG

SEQ ID NO: 207 - protein, 32 aa, Artificial; identical to SEQ ID NO: 127
  Humanized antibody sequence

SEQ ID NO: 208 - protein, 5 aa, Artificial
  Humanized antibody sequence
GVSNI

SEQ ID NO: 209 - protein, 11 aa, Artificial
  Humanized antibody sequence
WGQGTLVTVSS

SEQ ID NO: 210 - protein, 330 aa, Artificial; identical to SEQ ID NO: 10
  Humanized antibody sequence

SEQ ID NO: 211 - DNA, 1329 bp, Artificial
  Humanized antibody sequence
gaggtgcagcttgtggagtctgggggaggcttggtccagcctggggggtccctgagactctcctgtgcagcctctggttcctccctcagtaactttgacatgatctgggtccgtcaggctccagggaaggggctggagtccatcggaatcatttatgattttggtagcacatactacgccagctctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 212 - DNA, 339 bp, Artificial
  Humanized antibody sequence
gaggtgcagcttgtggagtctgggggaggcttggtccagcctggggggtccctgagactctcctgtgcagcctctggttcctccctcagtaactttgacatgatctgggtccgtcaggctccagggaaggggctggagtccatcggaatcatttatgattttggtagcacatactacgccagctctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagc

SEQ ID NO: 213 - DNA, 90 bp, Artificial
  Humanized antibody sequence
gaggtgcagcttgtggagtctgggggaggcttggtccagcctggggggtccctgagactctcctgtgcagcctctggttcctccctcagt

SEQ ID NO: 214 - DNA, 15 bp, Artificial
  Humanized antibody sequence
aactttgacatgatc

SEQ ID NO: 215 - DNA, 42 bp, Artificial; identical to SEQ ID NO: 135
  Humanized antibody sequence

SEQ ID NO: 216 - DNA, 48 bp, Artificial
  Humanized antibody sequence
atcatttatgattttggtagcacatactacgccagctctgctaaaggc

SEQ ID NO: 217 - DNA, 96 bp, Artificial; identical to SEQ ID NO: 137
  Humanized antibody sequence

SEQ ID NO: 218 - DNA, 15 bp, Artificial
  Humanized antibody sequence
ggtgtgagtaatatc

SEQ ID NO: 219 - DNA, 33 bp, Artificial; identical to SEQ ID NO: 139
  Humanized antibody sequence

SEQ ID NO: 220 - DNA, 990 bp, Artificial; identical to SEQ ID NO: 20
  Humanized antibody sequence

SEQ ID NO: 221 - protein, 219 aa, Artificial
  Humanized antibody sequence
DIQMTQSPSTLSASVGDRVTITCQASEDISSNLAWYQQKPGKAPKLLIYSASTLASGVPSRFSGSGSGTEFTLTISSLQPDDFATYYCQSYDGSSSSSYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 113 aa, Artificial
  Humanized antibody sequence
DIQMTQSPSTLSASVGDRVTITCQASEDISSNLAWYQQKPGKAPKLLIYSASTLASGVPSRFSGSGSGTEFTLTISSLQPDDFATYYCQSYDGSSSSSYGIGFGGGTKVEIKR

SEQ ID NO: 223 - protein, 23 aa, Artificial
  Humanized antibody sequence
DIQMTQSPSTLSASVGDRVTITC

SEQ ID NO: 224 - protein, 11 aa, Artificial
  Humanized antibody sequence
QASEDISSNLA

SEQ ID NO: 225 - protein, 15 aa, Artificial
  Humanized antibody sequence
WYQQKPGKAPKLLIY

SEQ ID NO: 226 - protein, 7 aa, Artificial
  Humanized antibody sequence
SASTLAS

SEQ ID NO: 227 - protein, 32 aa, Artificial; identical to SEQ ID NO: 147
  Humanized antibody sequence

SEQ ID NO: 228 - protein, 14 aa, Artificial
  Humanized antibody sequence
QSYDGSSSSSYGIG

SEQ ID NO: 229 - protein, 11 aa, Artificial
  Humanized antibody sequence
FGGGTKVEIKR

SEQ ID NO: 230 - protein, 106 aa, Artificial; identical to SEQ ID NO: 30
  Humanized antibody sequence

SEQ ID NO: 231 - DNA, 657 bp, Artificial
  Humanized antibody sequence
gacatccagatgacccagtctccttccaccctgtctgcatctgtaggagacagagtcaccatcacttgtcaggccagtgaggatattagtagtaacttagcctggtatcagcagaaaccaggaaaagcccctaagctcctgatctattctgcatccactctggcatctggagtcccatcaaggttcagcggcagtggatctggaacagaatttactctcaccatcagcagcctgcagcctgatgattttgcaacttactactgtcaaagctatgatggtagtagtagtagtagttatggtattggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 339 bp, Artificial
  Humanized antibody sequence
gacatccagatgacccagtctccttccaccctgtctgcatctgtaggagacagagtcaccatcacttgtcaggccagtgaggatattagtagtaacttagcctggtatcagcagaaaccaggaaaagcccctaagctcctgatctattctgcatccactctggcatctggagtcccatcaaggttcagcggcagtggatctggaacagaatttactctcaccatcagcagcctgcagcctgatgattttgcaacttactactgtcaaagctatgatggtagtagtagtagtagttatggtattggtttcggcggaggaaccaaggtggaaatcaaacgt

SEQ ID NO: 233 - DNA, 69 bp, Artificial; identical to SEQ ID NO: 153
  Humanized antibody sequence

SEQ ID NO: 234 - DNA, 33 bp, Artificial
  Humanized antibody sequence
caggccagtgaggatattagtagtaacttagcc

SEQ ID NO: 235 - DNA, 45 bp, Artificial; identical to SEQ ID NO: 155
  Humanized antibody sequence

SEQ ID NO: 236 - DNA, 21 bp, Artificial
  Humanized antibody sequence
tctgcatccactctggcatct

SEQ ID NO: 237 - DNA, 96 bp, Artificial
  Humanized antibody sequence
ggagtcccatcaaggttcagcggcagtggatctggaacagaatttactctcaccatcagcagcctgcagcctgatgattttgcaacttactactgt

SEQ ID NO: 238 - DNA, 42 bp, Artificial
  Humanized antibody sequence
caaagctatgatggtagtagtagtagtagttatggtattggt

SEQ ID NO: 239 - DNA, 33 bp, Artificial; identical to SEQ ID NO: 159
  Humanized antibody sequence

SEQ ID NO: 240 - DNA, 318 bp, Artificial; identical to SEQ ID NO: 160
  Humanized antibody sequence

SEQ ID NO: 241 - protein, 443 aa, Artificial
  Humanized antibody sequence
EVQLVESGGGLVQPGGSLRLSCAASGFTVSKHDMIWVRQAPGKGLESIGIIYDDGDTYYANSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 113 aa, Artificial
  Humanized antibody sequence
EVQLVESGGGLVQPGGSLRLSCAASGFTVSKHDMIWVRQAPGKGLESIGIIYDDGDTYYANSAKGRFTISRDNSKNTLYLQMNSLRAEDTAVYYCVKGVSNIWGQGTLVTVSS

SEQ ID NO: 243 - protein, 30 aa, Artificial; identical to SEQ ID NO: 123
  Humanized antibody sequence

SEQ ID NO: 244 - protein, 5 aa, Artificial
  Humanized antibody sequence
KHDMI

SEQ ID NO: 245 - protein, 14 aa, Artificial
  Humanized antibody sequence
WVRQAPGKGLESIG

SEQ ID NO: 246 - protein, 16 aa, Artificial
  Humanized antibody sequence
IIYDDGDTYYANSAKG

SEQ ID NO: 247 - protein, 32 aa, Artificial; identical to SEQ ID NO: 127
  Humanized antibody sequence

SEQ ID NO: 248 - protein, 5 aa, Artificial
  Humanized antibody sequence
GVSNI

SEQ ID NO: 249 - protein, 11 aa, Artificial
  Humanized antibody sequence
WGQGTLVTVSS

SEQ ID NO: 250 - protein, 330 aa, Artificial; identical to SEQ ID NO: 10
  Humanized antibody sequence

SEQ ID NO: 251 - DNA, 1329 bp, Artificial
  Humanized antibody sequence
gaggtgcagcttgtggagtctgggggaggcttggtccagcctggggggtccctgagactctcctgtgcagcctctggattcaccgtcagtaagcatgacatgatctgggtccgtcaggctccagggaaggggctggagtccatcggaatcatttatgatgatggtgatacatactacgctaattctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 252 - DNA, 339 bp, Artificial
  Humanized antibody sequence
gaggtgcagcttgtggagtctgggggaggcttggtccagcctggggggtccctgagactctcctgtgcagcctctggattcaccgtcagtaagcatgacatgatctgggtccgtcaggctccagggaaggggctggagtccatcggaatcatttatgatgatggtgatacatactacgctaattctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagc

SEQ ID NO: 253 - DNA, 90 bp, Artificial; identical to SEQ ID NO: 133
  Humanized antibody sequence

SEQ ID NO: 254 - DNA, 15 bp, Artificial
  Humanized antibody sequence
aagcatgacatgatc

SEQ ID NO: 255 - DNA, 42 bp, Artificial; identical to SEQ ID NO: 135
  Humanized antibody sequence

SEQ ID NO: 256 - DNA, 48 bp, Artificial
  Humanized antibody sequence
atcatttatgatgatggtgatacatactacgctaattctgctaaaggc

SEQ ID NO: 257 - DNA, 96 bp, Artificial; identical to SEQ ID NO: 137
  Humanized antibody sequence

SEQ ID NO: 258 - DNA, 15 bp, Artificial
  Humanized antibody sequence
ggtgtgagtaatatc

SEQ ID NO: 259 - DNA, 33 bp, Artificial; identical to SEQ ID NO: 139
  Humanized antibody sequence

SEQ ID NO: 260 - DNA, 990 bp, Artificial; identical to SEQ ID NO: 20
  Humanized antibody sequence

SEQ ID NO: 261 - protein, 219 aa, Artificial
  Humanized antibody sequence
DIQMTQSPSTLSASVGDRVTITCRASQSISVYLAWYQQKPGKAPKLLIYQASKLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 113 aa, Artificial
  Humanized antibody sequence
DIQMTQSPSTLSASVGDRVTITCRASQSISVYLAWYQQKPGKAPKLLIYQASKLASGVPSRFSGSGSGTEFTLTISSLQPDDFATYYCQSYDGSSSSSYGVGFGGGTKVEIKR

SEQ ID NO: 263 - protein, 23 aa, Artificial
  Humanized antibody sequence
DIQMTQSPSTLSASVGDRVTITC

SEQ ID NO: 264 - protein, 11 aa, Artificial
  Humanized antibody sequence
RASQSISVYLA

SEQ ID NO: 265 - protein, 15 aa, Artificial
  Humanized antibody sequence
WYQQKPGKAPKLLIY

SEQ ID NO: 266 - protein, 7 aa, Artificial
  Humanized antibody sequence
QASKLAS

SEQ ID NO: 267 - protein, 32 aa, Artificial; identical to SEQ ID NO: 147
  Humanized antibody sequence

SEQ ID NO: 268 - protein, 14 aa, Artificial
  Humanized antibody sequence
QSYDGSSSSSYGVG

SEQ ID NO: 269 - protein, 11 aa, Artificial
  Humanized antibody sequence
FGGGTKVEIKR

SEQ ID NO: 270 - protein, 106 aa, Artificial; identical to SEQ ID NO: 30
  Humanized antibody sequence

SEQ ID NO: 271 - DNA, 657 bp, Artificial
  Humanized antibody sequence
gacatccagatgacccagtctccttccaccctgtctgcatctgtaggagacagagtcaccatcacttgtagagccagtcagagcattagtgtctacctcgcctggtatcagcagaaaccaggaaaagcccctaagctcctgatctatcaggcatccaaactggcctctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 272 - DNA, 339 bp, Artificial
  Humanized antibody sequence
gacatccagatgacccagtctccttccaccctgtctgcatctgtaggagacagagtcaccatcacttgtagagccagtcagagcattagtgtctacctcgcctggtatcagcagaaaccaggaaaagcccctaagctcctgatctatcaggcatccaaactggcctctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgt

SEQ ID NO: 273 - DNA, 69 bp, Artificial; identical to SEQ ID NO: 153
  Humanized antibody sequence

SEQ ID NO: 274 - DNA, 33 bp, Artificial
  Humanized antibody sequence
agagccagtcagagcattagtgtctacctcgcc

SEQ ID NO: 275 - DNA, 45 bp, Artificial; identical to SEQ ID NO: 155
  Humanized antibody sequence

SEQ ID NO: 276 - DNA, 21 bp, Artificial
  Humanized antibody sequence
caggcatccaaactggcctct

SEQ ID NO: 277 - DNA, 96 bp, Artificial; identical to SEQ ID NO: 157
  Humanized antibody sequence

SEQ ID NO: 278 - DNA, 42 bp, Artificial
  Humanized antibody sequence
caaagctatgatggtagtagtagtagtagttatggtgttggt

SEQ ID NO: 279 - DNA, 33 bp, Artificial; identical to SEQ ID NO: 159
  Humanized antibody sequence

SEQ ID NO: 280 - DNA, 318 bp, Artificial; identical to SEQ ID NO: 160
  Humanized antibody sequence

SEQ ID NO: 281 - protein, 454 aa, Artificial
  Humanized antibody sequence
EVQLVESGGGLVQPGGSLRLSCAASGFSLTDYAMSWVRQAPGKGLEWIGIISDSGSTYYASSAKGRFTISRDNSKNTLYLQMNSLRAEDTAVYYCAREPEYGYDEYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 124 aa, Artificial
  Humanized antibody sequence
EVQLVESGGGLVQPGGSLRLSCAASGFSLTDYAMSWVRQAPGKGLEWIGIISDSGSTYYASSAKGRFTISRDNSKNTLYLQMNSLRAEDTAVYYCAREPEYGYDEYGDWVSDLWGQGTLVTVSS

SEQ ID NO: 283 - protein, 30 aa, Artificial
  Humanized antibody sequence
EVQLVESGGGLVQPGGSLRLSCAASGFSLT

SEQ ID NO: 284 - protein, 5 aa, Artificial
  Humanized antibody sequence
DYAMS

SEQ ID NO: 285 - protein, 14 aa, Artificial
  Humanized antibody sequence
WVRQAPGKGLEWIG

SEQ ID NO: 286 - protein, 16 aa, Artificial
  Humanized antibody sequence
IISDSGSTYYASSAKG

SEQ ID NO: 287 - protein, 32 aa, Artificial
  Humanized antibody sequence
RFTISRDNSKNTLYLQMNSLRAEDTAVYYCAR

SEQ ID NO: 288 - protein, 16 aa, Artificial
  Humanized antibody sequence
EPEYGYDEYGDWVSDL

SEQ ID NO: 289 - protein, 11 aa, Artificial
  Humanized antibody sequence
WGQGTLVTVSS

SEQ ID NO: 290 - protein, 330 aa, Artificial; identical to SEQ ID NO: 10
  Humanized antibody sequence

SEQ ID NO: 291 - DNA, 1362 bp, Artificial
  Humanized antibody sequence
gaggtgcagcttgtggagtctgggggaggcttggtccagcctggggggtccctgagactctcctgtgcagcctctggattctccctcactgactatgcaatgagctgggtccgtcaggctccagggaaggggctggagtggatcggaatcattagtgatagtggtagcacatactacgctagctctgctaaaggccgattcaccatctccagagacaattccaagaacaccctgtatcttcaaatgaacagcctgagagctgaggacactgctgtgtattactgtgctagagagcccgagtacggctacgatgagtatggtgattgggtttctgacttatggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 292 - DNA, 372 bp, Artificial
  Humanized antibody sequence
gaggtgcagcttgtggagtctgggggaggcttggtccagcctggggggtccctgagactctcctgtgcagcctctggattctccctcactgactatgcaatgagctgggtccgtcaggctccagggaaggggctggagtggatcggaatcattagtgatagtggtagcacatactacgctagctctgctaaaggccgattcaccatctccagagacaattccaagaacaccctgtatcttcaaatgaacagcctgagagctgaggacactgctgtgtattactgtgctagagagcccgagtacggctacgatgagtatggtgattgggtttctgacttatggggccaagggaccctcgtcaccgtctcgagc

SEQ ID NO: 293 - DNA, 90 bp, Artificial
  Humanized antibody sequence
gaggtgcagcttgtggagtctgggggaggcttggtccagcctggggggtccctgagactctcctgtgcagcctctggattctccctcact

SEQ ID NO: 294 - DNA, 15 bp, Artificial
  Humanized antibody sequence
gactatgcaatgagc

SEQ ID NO: 295 - DNA, 42 bp, Artificial
  Humanized antibody sequence
tgggtccgtcaggctccagggaaggggctggagtggatcgga

SEQ ID NO: 296 - DNA, 48 bp, Artificial
  Humanized antibody sequence
atcattagtgatagtggtagcacatactacgctagctctgctaaaggc

SEQ ID NO: 297 - DNA, 96 bp, Artificial
  Humanized antibody sequence
cgattcaccatctccagagacaattccaagaacaccctgtatcttcaaatgaacagcctgagagctgaggacactgctgtgtattactgtgctaga

SEQ ID NO: 298 - DNA, 48 bp, Artificial
  Humanized antibody sequence
gagcccgagtacggctacgatgagtatggtgattgggtttctgactta

SEQ ID NO: 299 - DNA, 33 bp, Artificial; identical to SEQ ID NO: 139
  Humanized antibody sequence

SEQ ID NO: 300 - DNA, 990 bp, Artificial; identical to SEQ ID NO: 20
  Humanized antibody sequence

SEQ ID NO: 301 - protein, 219 aa, Artificial
  Humanized antibody sequence
DIQMTQSPSTLSASVGDRVTITCQATQSIGNNLAWYQQKPGKAPKLLIYRASTLASGVPSRFSGSGSGTEFTLTISSLQPDDFATYYCQSYYYSSSITYHNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 113 aa, Artificial
  Humanized antibody sequence
DIQMTQSPSTLSASVGDRVTITCQATQSIGNNLAWYQQKPGKAPKLLIYRASTLASGVPSRFSGSGSGTEFTLTISSLQPDDFATYYCQSYYYSSSITYHNAFGGGTKVEIKR

SEQ ID NO: 303 - protein, 23 aa, Artificial
  Humanized antibody sequence
DIQMTQSPSTLSASVGDRVTITC

SEQ ID NO: 304 - protein, 11 aa, Artificial
  Humanized antibody sequence
QATQSIGNNLA

SEQ ID NO: 305 - protein, 15 aa, Artificial
  Humanized antibody sequence
WYQQKPGKAPKLLIY

SEQ ID NO: 306 - protein, 7 aa, Artificial
  Humanized antibody sequence
RASTLAS

SEQ ID NO: 307 - protein, 32 aa, Artificial; identical to SEQ ID NO: 147
  Humanized antibody sequence

SEQ ID NO: 308 - protein, 14 aa, Artificial
  Humanized antibody sequence
QSYYYSSSITYHNA

SEQ ID NO: 309 - protein, 11 aa, Artificial
  Humanized antibody sequence
FGGGTKVEIKR

SEQ ID NO: 310 - protein, 106 aa, Artificial; identical to SEQ ID NO: 30
  Humanized antibody sequence

SEQ ID NO: 311 - DNA, 657 bp, Artificial
  Humanized antibody sequence
gacatccagatgacccagtctccttccaccctgtctgcatctgtaggagacagagtcaccatcacttgtcaggccactcagagcattggtaataacttagcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcataatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 312 - DNA, 339 bp, Artificial
  Humanized antibody sequence
gacatccagatgacccagtctccttccaccctgtctgcatctgtaggagacagagtcaccatcacttgtcaggccactcagagcattggtaataacttagcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcataatgctttcggcggaggaaccaaggtggaaatcaaacgt

SEQ ID NO: 313 - DNA, 69 bp, Artificial; identical to SEQ ID NO: 153
  Humanized antibody sequence

SEQ ID NO: 314 - DNA, 33 bp, Artificial
  Humanized antibody sequence
caggccactcagagcattggtaataacttagcc

SEQ ID NO: 315 - DNA, 45 bp, Artificial; identical to SEQ ID NO: 155
  Humanized antibody sequence

SEQ ID NO: 316 - DNA, 21 bp, Artificial
  Humanized antibody sequence
agggcatccactctggcatct

SEQ ID NO: 317 - DNA, 96 bp, Artificial; identical to SEQ ID NO: 157
  Humanized antibody sequence

SEQ ID NO: 318 - DNA, 42 bp, Artificial
  Humanized antibody sequence
caaagctattactatagtagtagtattacttatcataatgct

SEQ ID NO: 319 - DNA, 33 bp, Artificial; identical to SEQ ID NO: 159
  Humanized antibody sequence

SEQ ID NO: 320 - DNA, 318 bp, Artificial; identical to SEQ ID NO: 40
  Humanized antibody sequence

SEQ ID NO: 321 - protein, 454 aa, Artificial
  Humanized antibody sequence
EVQLVESGGGLVQPGGSLRLSCAASGFSLSSYAMSWVRQAPGKGLEWIGIISDSGSTYYASSAKGRFTISRDNSKNTLYLQMNSLRAEDTAVYYCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 124 aa, Artificial
  Humanized antibody sequence
EVQLVESGGGLVQPGGSLRLSCAASGFSLSSYAMSWVRQAPGKGLEWIGIISDSGSTYYASSAKGRFTISRDNSKNTLYLQMNSLRAEDTAVYYCAREPEYGYDDYGDWVSDLWGQGTLVTVSS

SEQ ID NO: 323 - protein, 30 aa, Artificial
  Humanized antibody sequence
EVQLVESGGGLVQPGGSLRLSCAASGFSLS

SEQ ID NO: 324 - protein, 5 aa, Artificial
  Humanized antibody sequence
SYAMS

SEQ ID NO: 325 - protein, 14 aa, Artificial
  Humanized antibody sequence
WVRQAPGKGLEWIG

SEQ ID NO: 326 - protein, 16 aa, Artificial
  Humanized antibody sequence
IISDSGSTYYASSAKG

SEQ ID NO: 327 - protein, 32 aa, Artificial; identical to SEQ ID NO: 287
  Humanized antibody sequence

SEQ ID NO: 328 - protein, 16 aa, Artificial
  Humanized antibody sequence
EPEYGYDDYGDWVSDL

SEQ ID NO: 329 - protein, 11 aa, Artificial
  Humanized antibody sequence
WGQGTLVTVSS

SEQ ID NO: 330 - protein, 330 aa, Artificial; identical to SEQ ID NO: 10
  Humanized antibody sequence

SEQ ID NO: 331 - DNA, 1362 bp, Artificial
  Humanized antibody sequence
gaggtgcagcttgtggagtctgggggaggcttggtccagcctggggggtccctgagactctcctgtgcagcctctggattctccctcagtagctatgcaatgagctgggtccgtcaggctccagggaaggggctggagtggatcggaatcattagtgatagtggtagcacatactacgcgagctctgctaaaggccgattcaccatctccagagacaattccaagaacaccctgtatcttcaaatgaacagcctgagagctgaggacactgctgtgtattactgtgctagagagcccgagtacggctacgatgactatggtgattgggtttctgacttatggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 372 bp, Artificial
  Humanized antibody sequence
gaggtgcagcttgtggagtctgggggaggcttggtccagcctggggggtccctgagactctcctgtgcagcctctggattctccctcagtagctatgcaatgagctgggtccgtcaggctccagggaaggggctggagtggatcggaatcattagtgatagtggtagcacatactacgcgagctctgctaaaggccgattcaccatctccagagacaattccaagaacaccctgtatcttcaaatgaacagcctgagagctgaggacactgctgtgtattactgtgctagagagcccgagtacggctacgatgactatggtgattgggtttctgacttatggggccaagggaccctcgtcaccgtctcgagc

SEQ ID NO: 333 - DNA, 90 bp, Artificial
  Humanized antibody sequence
gaggtgcagcttgtggagtctgggggaggcttggtccagcctggggggtccctgagactctcctgtgcagcctctggattctccctcagt

SEQ ID NO: 334 - DNA, 15 bp, Artificial
  Humanized antibody sequence
agctatgcaatgagc

SEQ ID NO: 335 - DNA, 42 bp, Artificial; identical to SEQ ID NO: 295
  Humanized antibody sequence

SEQ ID NO: 336 - DNA, 48 bp, Artificial
  Humanized antibody sequence
atcattagtgatagtggtagcacatactacgcgagctctgctaaaggc

SEQ ID NO: 337 - DNA, 96 bp, Artificial; identical to SEQ ID NO: 297
  Humanized antibody sequence

SEQ ID NO: 338 - DNA, 48 bp, Artificial
  Humanized antibody sequence
gagcccgagtacggctacgatgactatggtgattgggtttctgactta

SEQ ID NO: 339 - DNA, 33 bp, Artificial; identical to SEQ ID NO: 139
  Humanized antibody sequence

SEQ ID NO: 340 - DNA, 990 bp, Artificial; identical to SEQ ID NO: 20
  Humanized antibody sequence

SEQ ID NO: 341 - protein, 219 aa, Artificial
  Humanized antibody sequence
DIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 113 aa, Artificial
  Humanized antibody sequence
DIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKR

SEQ ID NO: 343 - protein, 23 aa, Artificial
  Humanized antibody sequence
DIQMTQSPSTLSASVGDRVTITC

SEQ ID NO: 344 - protein, 11 aa, Artificial
  Humanized antibody sequence
QASQSISDYLS

SEQ ID NO: 345 - protein, 15 aa, Artificial
  Humanized antibody sequence
WYQQKPGKAPKLLIY

SEQ ID NO: 346 - protein, 7 aa, Artificial
  Humanized antibody sequence
RASTLAS

SEQ ID NO: 347 - protein, 32 aa, Artificial; identical to SEQ ID NO: 147
  Humanized antibody sequence

SEQ ID NO: 348 - protein, 14 aa, Artificial
  Humanized antibody sequence
QSYYYSSSITYRNA

SEQ ID NO: 349 - protein, 11 aa, Artificial
  Humanized antibody sequence
FGGGTKVEIKR

SEQ ID NO: 350 - protein, 106 aa, Artificial; identical to SEQ ID NO: 30
  Humanized antibody sequence

SEQ ID NO: 351 - DNA, 657 bp, Artificial
  Humanized antibody sequence
gacatccagatgacccagtctccttccaccctgtctgcatctgtaggagacagagtcaccatcacttgtcaggccagtcagagcattagtgattacttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcgtaatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 352 - DNA, 339 bp, Artificial
  Humanized antibody sequence
gacatccagatgacccagtctccttccaccctgtctgcatctgtaggagacagagtcaccatcacttgtcaggccagtcagagcattagtgattacttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcgtaatgctttcggcggaggaaccaaggtggaaatcaaacgt

SEQ ID NO: 353 - DNA, 69 bp, Artificial; identical to SEQ ID NO: 153
  Humanized antibody sequence

SEQ ID NO: 354 - DNA, 33 bp, Artificial
  Humanized antibody sequence
caggccagtcagagcattagtgattacttatcc

SEQ ID NO: 355 - DNA, 45 bp, Artificial; identical to SEQ ID NO: 155
  Humanized antibody sequence

SEQ ID NO: 356 - DNA, 21 bp, Artificial
  Humanized antibody sequence
agggcatccactctggcatct

SEQ ID NO: 357 - DNA, 96 bp, Artificial; identical to SEQ ID NO: 157
  Humanized antibody sequence

SEQ ID NO: 358 - DNA, 42 bp, Artificial
  Humanized antibody sequence
caaagctattactatagtagtagtattacttatcgtaatgct

SEQ ID NO: 359 - DNA, 33 bp, Artificial; identical to SEQ ID NO: 159
  Humanized antibody sequence

SEQ ID NO: 360 - DNA, 318 bp, Artificial; identical to SEQ ID NO: 40
  Humanized antibody sequence

SEQ ID NO: 361 - protein, 454 aa, Artificial; identical to SEQ ID NO: 321
  Humanized antibody sequence

SEQ ID NO: 362 - protein, 124 aa, Artificial; identical to SEQ ID NO: 322
  Humanized antibody sequence

SEQ ID NO: 363 - protein, 30 aa, Artificial; identical to SEQ ID NO: 323
  Humanized antibody sequence

SEQ ID NO: 364 - protein, 5 aa, Artificial
  Humanized antibody sequence
SYAMS

SEQ ID NO: 365 - protein, 14 aa, Artificial
  Humanized antibody sequence
WVRQAPGKGLEWIG

SEQ ID NO: 366 - protein, 16 aa, Artificial
  Humanized antibody sequence
IISDSGSTYYASSAKG

SEQ ID NO: 367 - protein, 32 aa, Artificial; identical to SEQ ID NO: 287
  Humanized antibody sequence

SEQ ID NO: 368 - protein, 16 aa, Artificial
  Humanized antibody sequence
EPEYGYDDYGDWVSDL

SEQ ID NO: 369 - protein, 11 aa, Artificial
  Humanized antibody sequence
WGQGTLVTVSS

SEQ ID NO: 370 - protein, 330 aa, Artificial; identical to SEQ ID NO: 10
  Humanized antibody sequence

SEQ ID NO: 371 - DNA, 1362 bp, Artificial; identical to SEQ ID NO: 331
  Humanized antibody sequence

SEQ ID NO: 372 - DNA, 372 bp, Artificial; identical to SEQ ID NO: 332
  Humanized antibody sequence

SEQ ID NO: 373 - DNA, 90 bp, Artificial; identical to SEQ ID NO: 333
  Humanized antibody sequence

SEQ ID NO: 374 - DNA, 15 bp, Artificial
  Humanized antibody sequence
agctatgcaatgagc

SEQ ID NO: 375 - DNA, 42 bp, Artificial; identical to SEQ ID NO: 295
  Humanized antibody sequence

SEQ ID NO: 376 - DNA, 48 bp, Artificial; identical to SEQ ID NO: 336
  Humanized antibody sequence

SEQ ID NO: 377 - DNA, 96 bp, Artificial; identical to SEQ ID NO: 297
  Humanized antibody sequence

SEQ ID NO: 378 - DNA, 48 bp, Artificial; identical to SEQ ID NO: 338
  Humanized antibody sequence

SEQ ID NO: 379 - DNA, 33 bp, Artificial; identical to SEQ ID NO: 139
  Humanized antibody sequence

SEQ ID NO: 380 - DNA, 990 bp, Artificial; identical to SEQ ID NO: 20
  Humanized antibody sequence

SEQ ID NO: 381 - protein, 220 aa, Artificial
  Humanized antibody sequence
ADIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 114 aa, Artificial
  Humanized antibody sequence
ADIQMTQSPSTLSASVGDRVTITCQASQSISDYLSWYQQKPGKAPKLLIYRASTLASGVPSRFSGSGSGTEFTLTISSLQPDDFATYYCQSYYYSSSITYRNAFGGGTKVEIKR

SEQ ID NO: 383 - protein, 24 aa, Artificial
  Humanized antibody sequence
ADIQMTQSPSTLSASVGDRVTITC

SEQ ID NO: 384 - protein, 11 aa, Artificial
  Humanized antibody sequence
QASQSISDYLS

SEQ ID NO: 385 - protein, 15 aa, Artificial
  Humanized antibody sequence
WYQQKPGKAPKLLIY

SEQ ID NO: 386 - protein, 7 aa, Artificial
  Humanized antibody sequence
RASTLAS

SEQ ID NO: 387 - protein, 32 aa, Artificial; identical to SEQ ID NO: 147
  Humanized antibody sequence

SEQ ID NO: 388 - protein, 14 aa, Artificial
  Humanized antibody sequence
QSYYYSSSITYRNA

SEQ ID NO: 389 - protein, 11 aa, Artificial
  Humanized antibody sequence
FGGGTKVEIKR

SEQ ID NO: 390 - protein, 106 aa, Artificial; identical to SEQ ID NO: 30
  Humanized antibody sequence

SEQ ID NO: 391 - DNA, 660 bp, Artificial
  Humanized antibody sequence
gctgacatccagatgacccagtctccttccaccctgtctgcatctgtaggagacagagtcaccatcacttgtcaggccagtcagagcattagtgattacttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcgtaatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 392 - DNA, 342 bp, Artificial
  Humanized antibody sequence
gctgacatccagatgacccagtctccttccaccctgtctgcatctgtaggagacagagtcaccatcacttgtcaggccagtcagagcattagtgattacttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttactactgtcaaagctattactatagtagtagtattacttatcgtaatgctttcggcggaggaaccaaggtggaaatcaaacgt

SEQ ID NO: 393 - DNA, 72 bp, Artificial
  Humanized antibody sequence
gctgacatccagatgacccagtctccttccaccctgtctgcatctgtaggagacagagtcaccatcacttgt

SEQ ID NO: 394 - DNA, 33 bp, Artificial; identical to SEQ ID NO: 354
  Humanized antibody sequence

SEQ ID NO: 395 - DNA, 45 bp, Artificial; identical to SEQ ID NO: 155
  Humanized antibody sequence

SEQ ID NO: 396 - DNA, 21 bp, Artificial
  Humanized antibody sequence
agggcatccactctggcatct

SEQ ID NO: 397 - DNA, 96 bp, Artificial; identical to SEQ ID NO: 157
  Humanized antibody sequence

SEQ ID NO: 398 - DNA, 42 bp, Artificial; identical to SEQ ID NO: 358
  Humanized antibody sequence

SEQ ID NO: 399 - DNA, 33 bp, Artificial; identical to SEQ ID NO: 159
  Humanized antibody sequence

SEQ ID NO: 400 - DNA, 318 bp, Artificial; identical to SEQ ID NO: 40
  Humanized antibody sequence

SEQ ID NO: 401 - protein, 443 aa, Artificial
  Humanized antibody sequence
EVQLVESGGGLVQPGGSLRLSCAASGFTVSSADMIWVRQAPGKGLESIGMIYDDGDTYYATSAKGRFTISRDNSKNTLYLQMNSLRAEDTAVYYCVKGVSSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 113 aa, Artificial
  Humanized antibody sequence
EVQLVESGGGLVQPGGSLRLSCAASGFTVSSADMIWVRQAPGKGLESIGMIYDDGDTYYATSAKGRFTISRDNSKNTLYLQMNSLRAEDTAVYYCVKGVSSVWGQGTLVTVSS

SEQ ID NO: 403 - protein, 30 aa, Artificial; identical to SEQ ID NO: 123
  Humanized antibody sequence

SEQ ID NO: 404 - protein, 5 aa, Artificial
  Humanized antibody sequence
SADMI

SEQ ID NO: 405 - protein, 14 aa, Artificial
  Humanized antibody sequence
WVRQAPGKGLESIG

SEQ ID NO: 406 - protein, 16 aa, Artificial
  Humanized antibody sequence
MIYDDGDTYYATSAKG

SEQ ID NO: 407 - protein, 32 aa, Artificial; identical to SEQ ID NO: 127
  Humanized antibody sequence

SEQ ID NO: 408 - protein, 5 aa, Artificial
  Humanized antibody sequence
GVSSV

SEQ ID NO: 409 - protein, 11 aa, Artificial
  Humanized antibody sequence
WGQGTLVTVSS

SEQ ID NO: 410 - protein, 330 aa, Artificial; identical to SEQ ID NO: 10
  Humanized antibody sequence

SEQ ID NO: 411 - DNA, 1329 bp, Artificial
  Humanized antibody sequence
gaggtgcagcttgtggagtctgggggaggcttggtccagcctggggggtccctgagactctcctgtgcagcctctggattcaccgtcagtagcgctgacatgatctgggtccgtcaggctccagggaaggggctggagtccatcggaatgatttatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtagtgtctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 412 - DNA, 339 bp, Artificial
  Humanized antibody sequence
gaggtgcagcttgtggagtctgggggaggcttggtccagcctggggggtccctgagactctcctgtgcagcctctggattcaccgtcagtagcgctgacatgatctgggtccgtcaggctccagggaaggggctggagtccatcggaatgatttatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtagtgtctggggccaagggaccctcgtcaccgtctcgagc

SEQ ID NO: 413 - DNA, 90 bp, Artificial; identical to SEQ ID NO: 133
  Humanized antibody sequence

SEQ ID NO: 414 - DNA, 15 bp, Artificial
  Humanized antibody sequence
agcgctgacatgatc

SEQ ID NO: 415 - DNA, 42 bp, Artificial; identical to SEQ ID NO: 135
  Humanized antibody sequence

SEQ ID NO: 416 - DNA, 48 bp, Artificial
  Humanized antibody sequence
atgatttatgatgatggtgacacatactacgctacttctgctaaaggc

SEQ ID NO: 417 - DNA, 96 bp, Artificial; identical to SEQ ID NO: 137
  Humanized antibody sequence

SEQ ID NO: 418 - DNA, 15 bp, Artificial
  Humanized antibody sequence
ggtgtgagtagtgtc

SEQ ID NO: 419 - DNA, 33 bp, Artificial; identical to SEQ ID NO: 139
  Humanized antibody sequence

SEQ ID NO: 420 - DNA, 990 bp, Artificial; identical to SEQ ID NO: 20
  Humanized antibody sequence

SEQ ID NO: 421 - protein, 219 aa, Artificial
  Humanized antibody sequence
DIQMTQSPSTLSASVGDRVTITCQASENIYRSLAWYQQKPGKAPKLLIYSASTLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 113 aa, Artificial
  Humanized antibody sequence
DIQMTQSPSTLSASVGDRVTITCQASENIYRSLAWYQQKPGKAPKLLIYSASTLASGVPSRFSGSGSGTEFTLTISSLQPDDFATYYCQSYDGSSSSSYGVGFGGGTKVEIKR

SEQ ID NO: 423 - protein, 23 aa, Artificial
  Humanized antibody sequence
DIQMTQSPSTLSASVGDRVTITC

SEQ ID NO: 424 - protein, 11 aa, Artificial
  Humanized antibody sequence
QASENIYRSLA

SEQ ID NO: 425 - protein, 15 aa, Artificial
  Humanized antibody sequence
WYQQKPGKAPKLLIY

SEQ ID NO: 426 - protein, 7 aa, Artificial
  Humanized antibody sequence
SASTLAS

SEQ ID NO: 427 - protein, 32 aa, Artificial; identical to SEQ ID NO: 147
  Humanized antibody sequence

SEQ ID NO: 428 - protein, 14 aa, Artificial
  Humanized antibody sequence
QSYDGSSSSSYGVG

SEQ ID NO: 429 - protein, 11 aa, Artificial
  Humanized antibody sequence
FGGGTKVEIKR

SEQ ID NO: 430 - protein, 106 aa, Artificial; identical to SEQ ID NO: 30
  Humanized antibody sequence

SEQ ID NO: 431 - DNA, 657 bp, Artificial
  Humanized antibody sequence
gacatccagatgacccagtctccttccaccctgtctgcatctgtaggagacagagtcaccatcacttgtcaggccagtgagaacatttacaggtctttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 432 - DNA, 339 bp, Artificial
  Humanized antibody sequence
gacatccagatgacccagtctccttccaccctgtctgcatctgtaggagacagagtcaccatcacttgtcaggccagtgagaacatttacaggtctttagcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgt

SEQ ID NO: 433 - DNA, 69 bp, Artificial; identical to SEQ ID NO: 153
  Humanized antibody sequence

SEQ ID NO: 434 - DNA, 33 bp, Artificial
  Humanized antibody sequence
caggccagtgagaacatttacaggtctttagcc

SEQ ID NO: 435 - DNA, 45 bp, Artificial; identical to SEQ ID NO: 155
  Humanized antibody sequence

SEQ ID NO: 436 - DNA, 21 bp, Artificial
  Humanized antibody sequence
tctgcatccactctggcatct

SEQ ID NO: 437 - DNA, 96 bp, Artificial; identical to SEQ ID NO: 157
  Humanized antibody sequence

SEQ ID NO: 438 - DNA, 42 bp, Artificial; identical to SEQ ID NO: 278
  Humanized antibody sequence

SEQ ID NO: 439 - DNA, 33 bp, Artificial; identical to SEQ ID NO: 159
  Humanized antibody sequence

SEQ ID NO: 440 - DNA, 318 bp, Artificial; identical to SEQ ID NO: 160
  Humanized antibody sequence

SEQ ID NO: 441 - protein, 443 aa, Artificial
  Humanized antibody sequence
EVQLVESGGGLVQPGGSLRLSCAASGFTVSAYDILWVRQAPGKGLESIGMMYDDGDTYYATSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 113 aa, Artificial
  Humanized antibody sequence
EVQLVESGGGLVQPGGSLRLSCAASGFTVSAYDILWVRQAPGKGLESIGMMYDDGDTYYATSAKGRFTISRDNSKNTLYLQMNSLRAEDTAVYYCVKGVSNIWGQGTLVTVSS

SEQ ID NO: 443 - protein, 30 aa, Artificial; identical to SEQ ID NO: 123
  Humanized antibody sequence

SEQ ID NO: 444 - protein, 5 aa, Artificial
  Humanized antibody sequence
AYDIL

SEQ ID NO: 445 - protein, 14 aa, Artificial
  Humanized antibody sequence
WVRQAPGKGLESIG

SEQ ID NO: 446 - protein, 16 aa, Artificial
  Humanized antibody sequence
MMYDDGDTYYATSAKG

SEQ ID NO: 447 - protein, 32 aa, Artificial; identical to SEQ ID NO: 127
  Humanized antibody sequence

SEQ ID NO: 448 - protein, 5 aa, Artificial
  Humanized antibody sequence
GVSNI

SEQ ID NO: 449 - protein, 11 aa, Artificial
  Humanized antibody sequence
WGQGTLVTVSS

SEQ ID NO: 450 - protein, 330 aa, Artificial; identical to SEQ ID NO: 10
  Humanized antibody sequence

SEQ ID NO: 451 - DNA, 1329 bp, Artificial
  Humanized antibody sequence
gaggtgcagcttgtggagtctgggggaggcttggtccagcctggggggtccctgagactctcctgtgcagcctctggattcaccgtcagtgcctatgacatcctctgggtccgtcaggctccagggaaggggctggagtccatcggaatgatgtatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 452 - DNA, 339 bp, Artificial
  Humanized antibody sequence
gaggtgcagcttgtggagtctgggggaggcttggtccagcctggggggtccctgagactctcctgtgcagcctctggattcaccgtcagtgcctatgacatcctctgggtccgtcaggctccagggaaggggctggagtccatcggaatgatgtatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagc

SEQ ID NO: 453 - DNA, 90 bp, Artificial; identical to SEQ ID NO: 133
  Humanized antibody sequence

SEQ ID NO: 454 - DNA, 15 bp, Artificial
  Humanized antibody sequence
gcctatgacatcctc

SEQ ID NO: 455 - DNA, 42 bp, Artificial; identical to SEQ ID NO: 135
  Humanized antibody sequence

SEQ ID NO: 456 - DNA, 48 bp, Artificial
  Humanized antibody sequence
atgatgtatgatgatggtgacacatactacgctacttctgctaaaggc

SEQ ID NO: 457 - DNA, 96 bp, Artificial; identical to SEQ ID NO: 137
  Humanized antibody sequence

SEQ ID NO: 458 - DNA, 15 bp, Artificial
  Humanized antibody sequence
ggtgtgagtaatatc

SEQ ID NO: 459 - DNA, 33 bp, Artificial; identical to SEQ ID NO: 139
  Humanized antibody sequence

SEQ ID NO: 460 - DNA, 990 bp, Artificial; identical to SEQ ID NO: 20
  Humanized antibody sequence

SEQ ID NO: 461 - protein, 219 aa, Artificial
  Humanized antibody sequence
DIQMTQSPSTLSASVGDRVTITCQASQSIDSSLAWYQQKPGKAPKLLIYSASTLASGVPSRFSGSGSGTEFTLTISSLQPDDFATYYCQSYDGSSSSYYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - protein, 113 aa, Artificial
  Humanized antibody sequence
DIQMTQSPSTLSASVGDRVTITCQASQSIDSSLAWYQQKPGKAPKLLIYSASTLASGVPSRFSGSGSGTEFTLTISSLQPDDFATYYCQSYDGSSSSYYGIGFGGGTKVEIKR

SEQ ID NO: 463 - protein, 23 aa, Artificial
  Humanized antibody sequence
DIQMTQSPSTLSASVGDRVTITC

SEQ ID NO: 464 - protein, 11 aa, Artificial
  Humanized antibody sequence
QASQSIDSSLA

SEQ ID NO: 465 - protein, 15 aa, Artificial
  Humanized antibody sequence
WYQQKPGKAPKLLIY

SEQ ID NO: 466 - protein, 7 aa, Artificial
  Humanized antibody sequence
SASTLAS

SEQ ID NO: 467 - protein, 32 aa, Artificial; identical to SEQ ID NO: 147
  Humanized antibody sequence

SEQ ID NO: 468 - protein, 14 aa, Artificial
  Humanized antibody sequence
QSYDGSSSSYYGIG

SEQ ID NO: 469 - protein, 11 aa, Artificial
  Humanized antibody sequence
FGGGTKVEIKR

SEQ ID NO: 470 - protein, 106 aa, Artificial; identical to SEQ ID NO: 30
  Humanized antibody sequence

SEQ ID NO: 471 - DNA, 657 bp, Artificial
  Humanized antibody sequence
gacatccagatgacccagtctccttccaccctgtctgcatctgtaggagacagagtcaccatcacttgtcaggccagtcagagcattgatagtagcttggcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtagtagttactatggtattggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 472 - DNA, 339 bp, Artificial
  Humanized antibody sequence
gacatccagatgacccagtctccttccaccctgtctgcatctgtaggagacagagtcaccatcacttgtcaggccagtcagagcattgatagtagcttggcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgatggtagtagtagtagttactatggtattggtttcggcggaggaaccaaggtggaaatcaaacgt

SEQ ID NO: 473 - DNA, 69 bp, Artificial; identical to SEQ ID NO: 153
  Humanized antibody sequence

SEQ ID NO: 474 - DNA, 33 bp, Artificial
  Humanized antibody sequence
caggccagtcagagcattgatagtagcttggcc

SEQ ID NO: 475 - DNA, 45 bp, Artificial; identical to SEQ ID NO: 155
  Humanized antibody sequence

SEQ ID NO: 476 - DNA, 21 bp, Artificial
  Humanized antibody sequence
tctgcatccactctggcatct

SEQ ID NO: 477 - DNA, 96 bp, Artificial; identical to SEQ ID NO: 157
  Humanized antibody sequence

SEQ ID NO: 478 - DNA, 42 bp, Artificial
  Humanized antibody sequence
caaagctatgatggtagtagtagtagttactatggtattggt

SEQ ID NO: 479 - DNA, 33 bp, Artificial; identical to SEQ ID NO: 159
  Humanized antibody sequence

SEQ ID NO: 480 - DNA, 318 bp, Artificial; identical to SEQ ID NO: 160
  Humanized antibody sequence

SEQ ID NO: 481 - protein, 443 aa, Artificial
  Humanized antibody sequence
EVQLVESGGGLVQPGGSLRLSCAASGFTVSAYDILWVRQAPGKGLESIGMMYDDGDTYYATSAKGRFTISRDNSKNTLYLQMNSLRAEDTAVYYCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 113 aa, Artificial; identical to SEQ ID NO: 442
  Humanized antibody sequence

SEQ ID NO: 483 - protein, 30 aa, Artificial; identical to SEQ ID NO: 123
  Humanized antibody sequence

SEQ ID NO: 484 - protein, 5 aa, Artificial
  Humanized antibody sequence
AYDIL

SEQ ID NO: 485 - protein, 14 aa, Artificial
  Humanized antibody sequence
WVRQAPGKGLESIG

SEQ ID NO: 486 - protein, 16 aa, Artificial
  Humanized antibody sequence
MMYDDGDTYYATSAKG

SEQ ID NO: 487 - protein, 32 aa, Artificial; identical to SEQ ID NO: 127
  Humanized antibody sequence

SEQ ID NO: 488 - protein, 5 aa, Artificial
  Humanized antibody sequence
GVSNI

SEQ ID NO: 489 - protein, 11 aa, Artificial
  Humanized antibody sequence
WGQGTLVTVSS

SEQ ID NO: 490 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - DNA, 1329 bp, Artificial
  Humanized antibody sequence
gaggtgcagcttgtggagtctgggggaggcttggtccagcctggggggtccctgagactctcctgtgcagcctctggattcaccgtcagtgcctatgacatcctctgggtccgtcaggctccagggaaggggctggagtccatcggaatgatgtatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtaatatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 492 - DNA, 339 bp, Artificial; identical to SEQ ID NO: 452
  Humanized antibody sequence

SEQ ID NO: 493 - DNA, 90 bp, Artificial; identical to SEQ ID NO: 133
  Humanized antibody sequence

SEQ ID NO: 494 - DNA, 15 bp, Artificial
  Humanized antibody sequence
gcctatgacatcctc

SEQ ID NO: 495 - DNA, 42 bp, Artificial; identical to SEQ ID NO: 135
  Humanized antibody sequence

SEQ ID NO: 496 - DNA, 48 bp, Artificial; identical to SEQ ID NO: 456
  Humanized antibody sequence

SEQ ID NO: 497 - DNA, 96 bp, Artificial; identical to SEQ ID NO: 137
  Humanized antibody sequence

SEQ ID NO: 498 - DNA, 15 bp, Artificial
  Humanized antibody sequence
ggtgtgagtaatatc

SEQ ID NO: 499 - DNA, 33 bp, Artificial; identical to SEQ ID NO: 139
  Humanized antibody sequence

SEQ ID NO: 500 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 501 - protein, 219 aa, Artificial
  Humanized antibody sequence
DIQMTQSPSTLSASVGDRVTITCQASQSIGSSLAWYQQKPGKAPKLLIYSASTLASGVPSRFSGSGSGTEFTLTISSLQPDDFATYYCQSYEGSSSSYYGIGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 113 aa, Artificial
  Humanized antibody sequence
DIQMTQSPSTLSASVGDRVTITCQASQSIGSSLAWYQQKPGKAPKLLIYSASTLASGVPSRFSGSGSGTEFTLTISSLQPDDFATYYCQSYEGSSSSYYGIGFGGGTKVEIKR

SEQ ID NO: 503 - protein, 23 aa, Artificial
  Humanized antibody sequence
DIQMTQSPSTLSASVGDRVTITC

SEQ ID NO: 504 - protein, 11 aa, Artificial
  Humanized antibody sequence
QASQSIGSSLA

SEQ ID NO: 505 - protein, 15 aa, Artificial
  Humanized antibody sequence
WYQQKPGKAPKLLIY

SEQ ID NO: 506 - protein, 7 aa, Artificial
  Humanized antibody sequence
SASTLAS

SEQ ID NO: 507 - protein, 32 aa, Artificial; identical to SEQ ID NO: 147
  Humanized antibody sequence

SEQ ID NO: 508 - protein, 14 aa, Artificial
  Humanized antibody sequence
QSYEGSSSSYYGIG

SEQ ID NO: 509 - protein, 11 aa, Artificial
  Humanized antibody sequence
FGGGTKVEIKR

SEQ ID NO: 510 - protein, 106 aa, Artificial; identical to SEQ ID NO: 30
  Humanized antibody sequence

SEQ ID NO: 511 - DNA, 657 bp, Artificial
  Humanized antibody sequence
gacatccagatgacccagtctccttccaccctgtctgcatctgtaggagacagagtcaccatcacttgtcaggccagtcagagcattggtagtagcttggcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgaaggtagtagtagtagttactatggtattggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 512 - DNA, 339 bp, Artificial
  Humanized antibody sequence
gacatccagatgacccagtctccttccaccctgtctgcatctgtaggagacagagtcaccatcacttgtcaggccagtcagagcattggtagtagcttggcctggtatcagcagaaaccaggaaaagcccctaagctcctgatctattctgcatccactctggcatctggagtcccatcaaggttcagcggcagtggatctggaacagaattcactctcaccatcagcagcctgcagcctgatgattttgcaacttactactgtcaaagctatgaaggtagtagtagtagttactatggtattggtttcggcggaggaaccaaggtggaaatcaaacgt

SEQ ID NO: 513 - DNA, 69 bp, Artificial; identical to SEQ ID NO: 153
  Humanized antibody sequence

SEQ ID NO: 514 - DNA, 33 bp, Artificial
  Humanized antibody sequence
caggccagtcagagcattggtagtagcttggcc

SEQ ID NO: 515 - DNA, 45 bp, Artificial; identical to SEQ ID NO: 155
  Humanized antibody sequence

SEQ ID NO: 516 - DNA, 21 bp, Artificial
  Humanized antibody sequence
tctgcatccactctggcatct

SEQ ID NO: 517 - DNA, 96 bp, Artificial; identical to SEQ ID NO: 157
  Humanized antibody sequence

SEQ ID NO: 518 - DNA, 42 bp, Artificial
  Humanized antibody sequence
caaagctatgaaggtagtagtagtagttactatggtattggt

SEQ ID NO: 519 - DNA, 33 bp, Artificial; identical to SEQ ID NO: 159
  Humanized antibody sequence

SEQ ID NO: 520 - DNA, 318 bp, Artificial; identical to SEQ ID NO: 160
  Humanized antibody sequence

SEQ ID NO: 521 - protein, 443 aa, Artificial
  Humanized antibody sequence
EVQLVESGGGLVQPGGSLRLSCAASGSSLSDYDMIWVRQAPGKGLESIGIIYDDGDTYYATSAKGRFTISRDNSKNTLYLQMNSLRAEDTAVYYCVKGVSNMWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 113 aa, Artificial
  Humanized antibody sequence
EVQLVESGGGLVQPGGSLRLSCAASGSSLSDYDMIWVRQAPGKGLESIGIIYDDGDTYYATSAKGRFTISRDNSKNTLYLQMNSLRAEDTAVYYCVKGVSNMWGQGTLVTVSS

SEQ ID NO: 523 - protein, 30 aa, Artificial; identical to SEQ ID NO: 203
  Humanized antibody sequence

SEQ ID NO: 524 - protein, 5 aa, Artificial
  Humanized antibody sequence
DYDMI

SEQ ID NO: 525 - protein, 14 aa, Artificial
  Humanized antibody sequence
WVRQAPGKGLESIG

SEQ ID NO: 526 - protein, 16 aa, Artificial
  Humanized antibody sequence
IIYDDGDTYYATSAKG

SEQ ID NO: 527 - protein, 32 aa, Artificial; identical to SEQ ID NO: 127
  Humanized antibody sequence

SEQ ID NO: 528 - protein, 5 aa, Artificial
  Humanized antibody sequence
GVSNM

SEQ ID NO: 529 - protein, 11 aa, Artificial
  Humanized antibody sequence
WGQGTLVTVSS

SEQ ID NO: 530 - protein, 330 aa, Artificial; identical to SEQ ID NO: 10
  Humanized antibody sequence

SEQ ID NO: 531 - DNA, 1329 bp, Artificial
  Humanized antibody sequence
gaggtgcagcttgtggagtctgggggaggcttggtccagcctggggggtccctgagactctcctgtgcagcctctggatcctccctcagtgattatgacatgatctgggtccgtcaggctccagggaaggggctggagtccatcggaatcatttatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtaatatgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - DNA, 339 bp, Artificial
  Humanized antibody sequence
gaggtgcagcttgtggagtctgggggaggcttggtccagcctggggggtccctgagactctcctgtgcagcctctggatcctccctcagtgattatgacatgatctgggtccgtcaggctccagggaaggggctggagtccatcggaatcatttatgatgatggtgacacatactacgctacttctgctaaaggccgattcaccatctccagagacaattccaagaacaccctgtatcttcaaatgaacagcctgagagctgaggacactgctgtgtattactgtgtcaaaggtgtgagtaatatgtggggccaagggaccctcgtcaccgtctcgagc

SEQ ID NO: 533 - DNA, 90 bp, Artificial
  Humanized antibody sequence
gaggtgcagcttgtggagtctgggggaggcttggtccagcctggggggtccctgagactctcctgtgcagcctctggatcctccctcagt

SEQ ID NO: 534 - DNA, 15 bp, Artificial
  Humanized antibody sequence
gattatgacatgatc

SEQ ID NO: 535 - DNA, 42 bp, Artificial; identical to SEQ ID NO: 135
  Humanized antibody sequence

SEQ ID NO: 536 - DNA, 48 bp, Artificial
  Humanized antibody sequence
atcatttatgatgatggtgacacatactacgctacttctgctaaaggc

SEQ ID NO: 537 - DNA, 96 bp, Artificial; identical to SEQ ID NO: 137
  Humanized antibody sequence

SEQ ID NO: 538 - DNA, 15 bp, Artificial
  Humanized antibody sequence
ggtgtgagtaatatg

SEQ ID NO: 539 - DNA, 33 bp, Artificial; identical to SEQ ID NO: 139
  Humanized antibody sequence

SEQ ID NO: 540 - DNA, 990 bp, Artificial; identical to SEQ ID NO: 20
  Humanized antibody sequence

SEQ ID NO: 541 - protein, 219 aa, Artificial
  Humanized antibody sequence
DIQMTQSPSTLSASVGDRVTITCQASQSIGSSLAWYQQKPGKAPKLLIYAASTLASGVPSRFSGSGSGTEFTLTISSLQPDDFATYYCQSYDGSSSSSYGVGFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 113 aa, Artificial
  Humanized antibody sequence
DIQMTQSPSTLSASVGDRVTITCQASQSIGSSLAWYQQKPGKAPKLLIYAASTLASGVPSRFSGSGSGTEFTLTISSLQPDDFATYYCQSYDGSSSSSYGVGFGGGTKVEIKR

SEQ ID NO: 543 - protein, 23 aa, Artificial
  Humanized antibody sequence
DIQMTQSPSTLSASVGDRVTITC

SEQ ID NO: 544 - protein, 11 aa, Artificial
  Humanized antibody sequence
QASQSIGSSLA

SEQ ID NO: 545 - protein, 15 aa, Artificial
  Humanized antibody sequence
WYQQKPGKAPKLLIY

SEQ ID NO: 546 - protein, 7 aa, Artificial
  Humanized antibody sequence
AASTLAS

SEQ ID NO: 547 - protein, 32 aa, Artificial; identical to SEQ ID NO: 147
  Humanized antibody sequence

SEQ ID NO: 548 - protein, 14 aa, Artificial
  Humanized antibody sequence
QSYDGSSSSSYGVG

SEQ ID NO: 549 - protein, 11 aa, Artificial
  Humanized antibody sequence
FGGGTKVEIKR

SEQ ID NO: 550 - protein, 106 aa, Artificial; identical to SEQ ID NO: 30
  Humanized antibody sequence

SEQ ID NO: 551 - DNA, 657 bp, Artificial
  Humanized antibody sequence
gacatccagatgacccagtctccttccaccctgtctgcatctgtaggagacagagtcaccatcacttgtcaggccagtcagagcattggtagtagcttagcctggtatcagcagaaaccaggaaaagcccctaagctcctgatctatgctgcatccactctggcatctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 552 - DNA, 339 bp, Artificial
  Humanized antibody sequence
gacatccagatgacccagtctccttccaccctgtctgcatctgtaggagacagagtcaccatcacttgtcaggccagtcagagcattggtagtagcttagcctggtatcagcagaaaccaggaaaagcccctaagctcctgatctatgctgcatccactctggcatctggagtcccatcaaggttcagcggcagtggatctggaacagaattcactctcaccatcagcagcctgcagcctgatgattttgcaacttactactgtcaaagctatgatggtagtagtagtagtagttatggtgttggtttcggcggaggaaccaaggtggaaatcaaacgt

SEQ ID NO: 553 - DNA, 69 bp, Artificial; identical to SEQ ID NO: 153
  Humanized antibody sequence

SEQ ID NO: 554 - DNA, 33 bp, Artificial
  Humanized antibody sequence
caggccagtcagagcattggtagtagcttagcc

SEQ ID NO: 555 - DNA, 45 bp, Artificial; identical to SEQ ID NO: 155
  Humanized antibody sequence

SEQ ID NO: 556 - DNA, 21 bp, Artificial
  Humanized antibody sequence
gctgcatccactctggcatct

SEQ ID NO: 557 - DNA, 96 bp, Artificial; identical to SEQ ID NO: 157
  Humanized antibody sequence

SEQ ID NO: 558 - DNA, 42 bp, Artificial; identical to SEQ ID NO: 278
  Humanized antibody sequence

SEQ ID NO: 559 - DNA, 33 bp, Artificial; identical to SEQ ID NO: 159
  Humanized antibody sequence

SEQ ID NO: 560 - DNA, 318 bp, Artificial; identical to SEQ ID NO: 160
  Humanized antibody sequence

SEQ ID NO: 561 - protein, 445 aa, Artificial
  Humanized antibody sequence
EVQLVESGGGLVQPGGSLRLSCAASGFTVSSGYDICWVRQAPGKGLEWIGCIDTGSGNTYYASSAKGRFTMSRDNSKNTVYLQMNSLRAEDTAVYYCAKGISSIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 115 aa, Artificial
  Humanized antibody sequence
EVQLVESGGGLVQPGGSLRLSCAASGFTVSSGYDICWVRQAPGKGLEWIGCIDTGSGNTYYASSAKGRFTMSRDNSKNTVYLQMNSLRAEDTAVYYCAKGISSIWGQGTLVTVSS

SEQ ID NO: 563 - protein, 30 aa, Artificial; identical to SEQ ID NO: 123
  Humanized antibody sequence

SEQ ID NO: 564 - protein, 6 aa, Artificial
  Humanized antibody sequence
SGYDIC

SEQ ID NO: 565 - protein, 14 aa, Artificial
  Humanized antibody sequence
WVRQAPGKGLEWIG

SEQ ID NO: 566 - protein, 17 aa, Artificial
  Humanized antibody sequence
CIDTGSGNTYYASSAKG

SEQ ID NO: 567 - protein, 32 aa, Artificial
  Humanized antibody sequence
RFTMSRDNSKNTVYLQMNSLRAEDTAVYYCAK

SEQ ID NO: 568 - protein, 5 aa, Artificial
  Humanized antibody sequence
GISSI

SEQ ID NO: 569 - protein, 11 aa, Artificial
  Humanized antibody sequence
WGQGTLVTVSS

SEQ ID NO: 570 - protein, 330 aa, Artificial; identical to SEQ ID NO: 490
  Humanized antibody sequence

SEQ ID NO: 571 - DNA, 1335 bp, Artificial
  Humanized antibody sequence
gaggtgcagcttgtggagtctgggggaggcttggtccagcctggggggtccctgagactctcctgtgcagcctctggattcaccgtcagtagcggctacgacatctgctgggtccgtcaggctccagggaaggggctggagtggatcggatgcattgatactggtagtggtaacacttactacgctagctctgctaaaggccgattcaccatgtccagagacaattccaagaacaccgtgtatcttcaaatgaacagcctgagagctgaggacactgctgtgtattactgtgctaagggtatttctagtatatggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 572 - DNA, 345 bp, Artificial
  Humanized antibody sequence
gaggtgcagcttgtggagtctgggggaggcttggtccagcctggggggtccctgagactctcctgtgcagcctctggattcaccgtcagtagcggctacgacatctgctgggtccgtcaggctccagggaaggggctggagtggatcggatgcattgatactggtagtggtaacacttactacgctagctctgctaaaggccgattcaccatgtccagagacaattccaagaacaccgtgtatcttcaaatgaacagcctgagagctgaggacactgctgtgtattactgtgctaagggtatttctagtatatggggccaagggaccctcgtcaccgtctcgagc

SEQ ID NO: 573 - DNA, 90 bp, Artificial; identical to SEQ ID NO: 133
  Humanized antibody sequence

SEQ ID NO: 574 - DNA, 18 bp, Artificial
  Humanized antibody sequence
agcggctacgacatctgc

SEQ ID NO: 575 - DNA, 42 bp, Artificial; identical to SEQ ID NO: 295
  Humanized antibody sequence

SEQ ID NO: 576 - DNA, 51 bp, Artificial
  Humanized antibody sequence
tgcattgatactggtagtggtaacacttactacgctagctctgctaaaggc

SEQ ID NO: 577 - DNA, 96 bp, Artificial
  Humanized antibody sequence
cgattcaccatgtccagagacaattccaagaacaccgtgtatcttcaaatgaacagcctgagagctgaggacactgctgtgtattactgtgctaag

SEQ ID NO: 578 - DNA, 15 bp, Artificial
  Humanized antibody sequence
ggtatttctagtata

SEQ ID NO: 579 - DNA, 33 bp, Artificial; identical to SEQ ID NO: 139
  Humanized antibody sequence

SEQ ID NO: 580 - DNA, 990 bp, Artificial; identical to SEQ ID NO: 500
  Humanized antibody sequence

SEQ ID NO: 581 - protein, 217 aa, Artificial
  Humanized antibody sequence
DIQMTQSPSTLSASVGDRVTITCQASQTISSDLAWYQQKPGKAPKLLIYAASKLTSGVPSRFSGSGSGTEFTLTISSLQPDDFATYYCQTYYDIIDDGATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 111 aa, Artificial
  Humanized antibody sequence
DIQMTQSPSTLSASVGDRVTITCQASQTISSDLAWYQQKPGKAPKLLIYAASKLTSGVPSRFSGSGSGTEFTLTISSLQPDDFATYYCQTYYDIIDDGATFGGGTKVEIKR

SEQ ID NO: 583 - protein, 23 aa, Artificial
  Humanized antibody sequence
DIQMTQSPSTLSASVGDRVTITC

SEQ ID NO: 584 - protein, 11 aa, Artificial
  Humanized antibody sequence
QASQTISSDLA

SEQ ID NO: 585 - protein, 15 aa, Artificial
  Humanized antibody sequence
WYQQKPGKAPKLLIY

SEQ ID NO: 586 - protein, 7 aa, Artificial
  Humanized antibody sequence
AASKLTS

SEQ ID NO: 587 - protein, 32 aa, Artificial; identical to SEQ ID NO: 147
  Humanized antibody sequence

SEQ ID NO: 588 - protein, 12 aa, Artificial
  Humanized antibody sequence
QTYYDIIDDGAT

SEQ ID NO: 589 - protein, 11 aa, Artificial
  Humanized antibody sequence
FGGGTKVEIKR

SEQ ID NO: 590 - protein, 106 aa, Artificial; identical to SEQ ID NO: 30
  Humanized antibody sequence

SEQ ID NO: 591 - DNA, 651 bp, Artificial
  Humanized antibody sequence
gacatccagatgacccagtctccttccaccctgtctgcatctgtaggagacagagtcaccatcacttgtcaggccagtcagaccattagtagcgacttagcctggtatcagcagaaaccaggaaaagcccctaagctcctgatctatgctgcatccaagctgacatctggagtcccatcaaggttcagcggcagtggatctggaacagaattcactctcaccatcagcagcctgcagcctgatgattttgcaacttactactgtcaaacatactatgatatcattgatgatggtgctactttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 592 - DNA, 333 bp, Artificial
  Humanized antibody sequence
gacatccagatgacccagtctccttccaccctgtctgcatctgtaggagacagagtcaccatcacttgtcaggccagtcagaccattagtagcgacttagcctggtatcagcagaaaccaggaaaagcccctaagctcctgatctatgctgcatccaagctgacatctggagtcccatcaaggttcagcggcagtggatctggaacagaattcactctcaccatcagcagcctgcagcctgatgattttgcaacttactactgtcaaacatactatgatatcattgatgatggtgctactttcggcggaggaaccaaggtggaaatcaaacgt

SEQ ID NO: 593 - DNA, 69 bp, Artificial; identical to SEQ ID NO: 153
  Humanized antibody sequence

SEQ ID NO: 594 - DNA, 33 bp, Artificial; identical to SEQ ID NO: 34
  Humanized antibody sequence

SEQ ID NO: 595 - DNA, 45 bp, Artificial; identical to SEQ ID NO: 155
  Humanized antibody sequence

SEQ ID NO: 596 - DNA, 21 bp, Artificial
  Humanized antibody sequence
gctgcatccaagctgacatct

SEQ ID NO: 597 - DNA, 96 bp, Artificial; identical to SEQ ID NO: 157
  Humanized antibody sequence

SEQ ID NO: 598 - DNA, 36 bp, Artificial
  Humanized antibody sequence
caaacatactatgatatcattgatgatggtgctact

SEQ ID NO: 599 - DNA, 33 bp, Artificial; identical to SEQ ID NO: 159
  Humanized antibody sequence

SEQ ID NO: 600 - DNA, 318 bp, Artificial; identical to SEQ ID NO: 160
  Humanized antibody sequence

SEQ ID NO: 601 - protein, 445 aa, Artificial
  Humanized antibody sequence
QQQLVESGGGLVQPGGSLRLSCAASGFTVSDTYDMCWVRQAPGKGLEWIGCIDTGSGDTYYPTSAKGRFTISRDNSKNTLYLQMNSLRAEDTAVYYCAKGVSSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 115 aa, Artificial
  Humanized antibody sequence
QQQLVESGGGLVQPGGSLRLSCAASGFTVSDTYDMCWVRQAPGKGLEWIGCIDTGSGDTYYPTSAKGRFTISRDNSKNTLYLQMNSLRAEDTAVYYCAKGVSSLWGQGTLVTVSS

SEQ ID NO: 603 - protein, 30 aa, Artificial
  Humanized antibody sequence
QQQLVESGGGLVQPGGSLRLSCAASGFTVS

SEQ ID NO: 604 - protein, 6 aa, Artificial
  Humanized antibody sequence
DTYDMC

SEQ ID NO: 605 - protein, 14 aa, Artificial
  Humanized antibody sequence
WVRQAPGKGLEWIG

SEQ ID NO: 606 - protein, 17 aa, Artificial
  Humanized antibody sequence
CIDTGSGDTYYPTSAKG

SEQ ID NO: 607 - protein, 32 aa, Artificial
  Humanized antibody sequence
RFTISRDNSKNTLYLQMNSLRAEDTAVYYCAK

SEQ ID NO: 608 - protein, 5 aa, Artificial
  Humanized antibody sequence
GVSSL

SEQ ID NO: 609 - protein, 11 aa, Artificial
  Humanized antibody sequence
WGQGTLVTVSS

SEQ ID NO: 610 - protein, 330 aa, Artificial; identical to SEQ ID NO: 10
  Humanized antibody sequence

SEQ ID NO: 611 - DNA, 1335 bp, Artificial
  Humanized antibody sequence
cagcagcagcttgtggagtctgggggaggcttggtccagcctggggggtccctgagactctcctgtgcagcctctggattcaccgtcagtgacacctacgacatgtgctgggtccgtcaggctccagggaaggggctggagtggatcggatgcatcgatactggtagtggtgacacttactacccaacctctgctaaaggccgattcaccatctccagagacaattccaagaacaccctgtatcttcaaatgaacagcctgagagctgaggacactgctgtgtattactgtgctaagggtgtttccagtttatggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 612 - DNA, 345 bp, Artificial
  Humanized antibody sequence
cagcagcagcttgtggagtctgggggaggcttggtccagcctggggggtccctgagactctcctgtgcagcctctggattcaccgtcagtgacacctacgacatgtgctgggtccgtcaggctccagggaaggggctggagtggatcggatgcatcgatactggtagtggtgacacttactacccaacctctgctaaaggccgattcaccatctccagagacaattccaagaacaccctgtatcttcaaatgaacagcctgagagctgaggacactgctgtgtattactgtgctaagggtgtttccagtttatggggccaagggaccctcgtcaccgtctcgagc

SEQ ID NO: 613 - DNA, 90 bp, Artificial
  Humanized antibody sequence
cagcagcagcttgtggagtctgggggaggcttggtccagcctggggggtccctgagactctcctgtgcagcctctggattcaccgtcagt

SEQ ID NO: 614 - DNA, 18 bp, Artificial
  Humanized antibody sequence
gacacctacgacatgtgc

SEQ ID NO: 615 - DNA, 42 bp, Artificial; identical to SEQ ID NO: 295
  Humanized antibody sequence

SEQ ID NO: 616 - DNA, 51 bp, Artificial
  Humanized antibody sequence
tgcatcgatactggtagtggtgacacttactacccaacctctgctaaaggc

SEQ ID NO: 617 - DNA, 96 bp, Artificial
  Humanized antibody sequence
cgattcaccatctccagagacaattccaagaacaccctgtatcttcaaatgaacagcctgagagctgaggacactgctgtgtattactgtgctaag

SEQ ID NO: 618 - DNA, 15 bp, Artificial
  Humanized antibody sequence
ggtgtttccagttta

SEQ ID NO: 619 - DNA, 33 bp, Artificial; identical to SEQ ID NO: 139
  Humanized antibody sequence

SEQ ID NO: 620 - DNA, 990 bp, Artificial; identical to SEQ ID NO: 20
  Humanized antibody sequence

SEQ ID NO: 621 - protein, 217 aa, Artificial
  Humanized antibody sequence
DIQMTQSPSTLSASVGDRVTITCQASEDIESDLAWYQQKPGKAPKLLIYGASTLKSGVPSRFSGSGSGTEYTLTISSLQPDDFATYYCQTYYDMADDGASFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 111 aa, Artificial
  Humanized antibody sequence
DIQMTQSPSTLSASVGDRVTITCQASEDIESDLAWYQQKPGKAPKLLIYGASTLKSGVPSRFSGSGSGTEYTLTISSLQPDDFATYYCQTYYDMADDGASFGGGTKVEIKR

SEQ ID NO: 623 - protein, 23 aa, Artificial
  Humanized antibody sequence
DIQMTQSPSTLSASVGDRVTITC

SEQ ID NO: 624 - protein, 11 aa, Artificial
  Humanized antibody sequence
QASEDIESDLA

SEQ ID NO: 625 - protein, 15 aa, Artificial
  Humanized antibody sequence
WYQQKPGKAPKLLIY

SEQ ID NO: 626 - protein, 7 aa, Artificial
  Humanized antibody sequence
GASTLKS

SEQ ID NO: 627 - protein, 32 aa, Artificial
  Humanized antibody sequence
GVPSRFSGSGSGTEYTLTISSLQPDDFATYYC

SEQ ID NO: 628 - protein, 12 aa, Artificial
  Humanized antibody sequence
QTYYDMADDGAS

SEQ ID NO: 629 - protein, 11 aa, Artificial
  Humanized antibody sequence
FGGGTKVEIKR

SEQ ID NO: 630 - protein, 106 aa, Artificial; identical to SEQ ID NO: 30
  Humanized antibody sequence

SEQ ID NO: 631 - DNA, 651 bp, Artificial
  Humanized antibody sequence
gacatccagatgacccagtctccttccaccctgtctgcatctgtaggagacagagtcaccatcacttgtcaggccagtgaggacattgaaagcgatttagcctggtatcagcagaaaccaggaaaagcccctaagctcctgatctatggtgcatccactctgaagtctggagtcccatcaaggttcagcggcagtggatctggaacagaatacactctcaccatcagcagcctgcagcctgatgattttgcaacttactactgtcaaacctattatgatatggctgatgatggtgctagtttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 632 - DNA, 333 bp, Artificial
  Humanized antibody sequence
gacatccagatgacccagtctccttccaccctgtctgcatctgtaggagacagagtcaccatcacttgtcaggccagtgaggacattgaaagcgatttagcctggtatcagcagaaaccaggaaaagcccctaagctcctgatctatggtgcatccactctgaagtctggagtcccatcaaggttcagcggcagtggatctggaacagaatacactctcaccatcagcagcctgcagcctgatgattttgcaacttactactgtcaaacctattatgatatggctgatgatggtgctagtttcggcggaggaaccaaggtggaaatcaaacgt

SEQ ID NO: 633 - DNA, 69 bp, Artificial; identical to SEQ ID NO: 153
  Humanized antibody sequence

SEQ ID NO: 634 - DNA, 33 bp, Artificial; identical to SEQ ID NO: 74
  Humanized antibody sequence

SEQ ID NO: 635 - DNA, 45 bp, Artificial; identical to SEQ ID NO: 155
  Humanized antibody sequence

SEQ ID NO: 636 - DNA, 21 bp, Artificial
  Humanized antibody sequence
ggtgcatccactctgaagtct

SEQ ID NO: 637 - DNA, 96 bp, Artificial
  Humanized antibody sequence
ggagtcccatcaaggttcagcggcagtggatctggaacagaatacactctcaccatcagcagcctgcagcctgatgattttgcaacttactactgt

SEQ ID NO: 638 - DNA, 36 bp, Artificial
  Humanized antibody sequence
caaacctattatgatatggctgatgatggtgctagt

SEQ ID NO: 639 - DNA, 33 bp, Artificial; identical to SEQ ID NO: 159
  Humanized antibody sequence

SEQ ID NO: 640 - DNA, 318 bp, Artificial; identical to SEQ ID NO: 40
  Humanized antibody sequence

SEQ ID NO: 641 - protein, 445 aa, Artificial
  Humanized antibody sequence
QQQLVESGGGLVQPGGSLRLSCAASGFTVSSGYDICWVRQAPGKGLEWIGCIDTGSGNTYYASSAKGRFTISRDNSKNTLYLQMNSLRAEDTAVYYCAKGISSLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 115 aa, Artificial
  Humanized antibody sequence
QQQLVESGGGLVQPGGSLRLSCAASGFTVSSGYDICWVRQAPGKGLEWIGCIDTGSGNTYYASSAKGRFTISRDNSKNTLYLQMNSLRAEDTAVYYCAKGISSLWGQGTLVTVSS

SEQ ID NO: 643 - protein, 30 aa, Artificial; identical to SEQ ID NO: 603
  Humanized antibody sequence

SEQ ID NO: 644 - protein, 6 aa, Artificial
  Humanized antibody sequence
SGYDIC

SEQ ID NO: 645 - protein, 14 aa, Artificial
  Humanized antibody sequence
WVRQAPGKGLEWIG

SEQ ID NO: 646 - protein, 17 aa, Artificial
  Humanized antibody sequence
CIDTGSGNTYYASSAKG

SEQ ID NO: 647 - protein, 32 aa, Artificial; identical to SEQ ID NO: 607
  Humanized antibody sequence

SEQ ID NO: 648 - protein, 5 aa, Artificial
  Humanized antibody sequence
GISSL

SEQ ID NO: 649 - protein, 11 aa, Artificial
  Humanized antibody sequence
WGQGTLVTVSS

SEQ ID NO: 650 - protein, 330 aa, Artificial; identical to SEQ ID NO: 10
  Humanized antibody sequence

SEQ ID NO: 651 - DNA, 1335 bp, Artificial
  Humanized antibody sequence
cagcagcagcttgtggagtctgggggaggcttggtccagcctggggggtccctgagactctcctgtgcagcctctggattcaccgtcagtagcggctacgacatctgctgggtccgtcaggctccagggaaggggctggagtggatcggatgcattgatactggtagtggtaacacttactacgccagctctgcaaaaggccgattcaccatctccagagacaattccaagaacaccctgtatcttcaaatgaacagcctgagagctgaggacactgctgtgtattactgtgctaagggtatttctagtttatggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 652 - DNA, 345 bp, Artificial
  Humanized antibody sequence
cagcagcagcttgtggagtctgggggaggcttggtccagcctggggggtccctgagactctcctgtgcagcctctggattcaccgtcagtagcggctacgacatctgctgggtccgtcaggctccagggaaggggctggagtggatcggatgcattgatactggtagtggtaacacttactacgccagctctgcaaaaggccgattcaccatctccagagacaattccaagaacaccctgtatcttcaaatgaacagcctgagagctgaggacactgctgtgtattactgtgctaagggtatttctagtttatggggccaagggaccctcgtcaccgtctcgagc

SEQ ID NO: 653 - DNA, 90 bp, Artificial; identical to SEQ ID NO: 613
  Humanized antibody sequence

SEQ ID NO: 654 - DNA, 18 bp, Artificial
  Humanized antibody sequence
agcggctacgacatctgc

SEQ ID NO: 655 - DNA, 42 bp, Artificial; identical to SEQ ID NO: 295
  Humanized antibody sequence

SEQ ID NO: 656 - DNA, 51 bp, Artificial
  Humanized antibody sequence
tgcattgatactggtagtggtaacacttactacgccagctctgcaaaaggc

SEQ ID NO: 657 - DNA, 96 bp, Artificial; identical to SEQ ID NO: 617
  Humanized antibody sequence

SEQ ID NO: 658 - DNA, 15 bp, Artificial
  Humanized antibody sequence
ggtatttctagttta

SEQ ID NO: 659 - DNA, 33 bp, Artificial; identical to SEQ ID NO: 139
  Humanized antibody sequence

SEQ ID NO: 660 - DNA, 990 bp, Artificial; identical to SEQ ID NO: 20
  Humanized antibody sequence

SEQ ID NO: 661 - protein, 217 aa, Artificial
  Humanized antibody sequence
DIQMTQSPSTLSASVGDRVTITCQASQTISSDLAWYQQKPGKAPKLLIYAASKLTSGVPSRFSGSGSGTEFTLTISSLQPDDFATYYCQTYYDISDDGATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 111 aa, Artificial
  Humanized antibody sequence
DIQMTQSPSTLSASVGDRVTITCQASQTISSDLAWYQQKPGKAPKLLIYAASKLTSGVPSRFSGSGSGTEFTLTISSLQPDDFATYYCQTYYDISDDGATFGGGTKVEIKR

SEQ ID NO: 663 - protein, 23 aa, Artificial
  Humanized antibody sequence
DIQMTQSPSTLSASVGDRVTITC

SEQ ID NO: 664 - protein, 11 aa, Artificial
  Humanized antibody sequence
QASQTISSDLA

SEQ ID NO: 665 - protein, 15 aa, Artificial
  Humanized antibody sequence
WYQQKPGKAPKLLIY

SEQ ID NO: 666 - protein, 7 aa, Artificial
  Humanized antibody sequence
AASKLTS

SEQ ID NO: 667 - protein, 32 aa, Artificial; identical to SEQ ID NO: 147
  Humanized antibody sequence

SEQ ID NO: 668 - protein, 12 aa, Artificial
  Humanized antibody sequence
QTYYDISDDGAT

SEQ ID NO: 669 - protein, 11 aa, Artificial
  Humanized antibody sequence
FGGGTKVEIKR

SEQ ID NO: 670 - protein, 106 aa, Artificial; identical to SEQ ID NO: 30
  Humanized antibody sequence

SEQ ID NO: 671 - DNA, 651 bp, Artificial
  Humanized antibody sequence
gacatccagatgacccagtctccttccaccctgtctgcatctgtaggagacagagtcaccatcacttgtcaggccagtcagaccattagtagcgacttagcctggtatcagcagaaaccaggaaaagcccctaagctcctgatctatgctgcatccaaactgacatctggagtcccatcaaggttcagcggcagtggatctggaacagaattcactctcaccatcagcagcctgcagcctgatgattttgcaacttactactgtcaaacctattatgatattagtgatgatggtgctactttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 672 - DNA, 333 bp, Artificial
  Humanized antibody sequence
gacatccagatgacccagtctccttccaccctgtctgcatctgtaggagacagagtcaccatcacttgtcaggccagtcagaccattagtagcgacttagcctggtatcagcagaaaccaggaaaagcccctaagctcctgatctatgctgcatccaaactgacatctggagtcccatcaaggttcagcggcagtggatctggaacagaattcactctcaccatcagcagcctgcagcctgatgattttgcaacttactactgtcaaacctattatgatattagtgatgatggtgctactttcggcggaggaaccaaggtggaaatcaaacgt

SEQ ID NO: 673 - DNA, 69 bp, Artificial; identical to SEQ ID NO: 153
  Humanized antibody sequence

SEQ ID NO: 674 - DNA, 33 bp, Artificial; identical to SEQ ID NO: 34
  Humanized antibody sequence

SEQ ID NO: 675 - DNA, 45 bp, Artificial; identical to SEQ ID NO: 155
  Humanized antibody sequence

SEQ ID NO: 676 - DNA, 21 bp, Artificial
  Humanized antibody sequence
gctgcatccaaactgacatct

SEQ ID NO: 677 - DNA, 96 bp, Artificial; identical to SEQ ID NO: 157
  Humanized antibody sequence

SEQ ID NO: 678 - DNA, 36 bp, Artificial
  Humanized antibody sequence
caaacctattatgatattagtgatgatggtgctact

SEQ ID NO: 679 - DNA, 33 bp, Artificial; identical to SEQ ID NO: 159
  Humanized antibody sequence

SEQ ID NO: 680 - DNA, 318 bp, Artificial; identical to SEQ ID NO: 40
  Humanized antibody sequence

SEQ ID NO: 681 - protein, 440 aa, Artificial
  Humanized antibody sequence
QSVKESGGRLVTPGTPLTLTCTVSGFSLSNYDMIWVRQAPGKGLESIGMIYDDGDTYYASWAKGRFTISKTSTTVDLKIISPTTEDTATYFCVKGVSNHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 110 aa, Artificial
  Humanized antibody sequence
QSVKESGGRLVTPGTPLTLTCTVSGFSLSNYDMIWVRQAPGKGLESIGMIYDDGDTYYASWAKGRFTISKTSTTVDLKIISPTTEDTATYFCVKGVSNHWGPGTLVTVSS

SEQ ID NO: 683 - protein, 29 aa, Oryctolagus cuniculus
QSVKESGGRLVTPGTPLTLTCTVSGFSLS

SEQ ID NO: 684 - protein, 5 aa, Oryctolagus cuniculus
NYDMI

SEQ ID NO: 685 - protein, 14 aa, Oryctolagus cuniculus
WVRQAPGKGLESIG

SEQ ID NO: 686 - protein, 16 aa, Oryctolagus cuniculus
MIYDDGDTYYASWAKG

SEQ ID NO: 687 - protein, 30 aa, Oryctolagus cuniculus
RFTISKTSTTVDLKIISPTTEDTATYFCVK

SEQ ID NO: 688 - protein, 5 aa, Oryctolagus cuniculus
GVSNH

SEQ ID NO: 689 - protein, 11 aa, Artificial
  Humanized antibody sequence
WGPGTLVTVSS

SEQ ID NO: 690 - protein, 330 aa, Artificial; identical to SEQ ID NO: 10
  Humanized antibody sequence

SEQ ID NO: 691 - DNA, 1320 bp, Artificial
  Humanized antibody sequence
cagtcagtgaaggagtccgggggtcgcctggtcacgcctgggacacccctgacactcacctgcacagtctctggattctccctcagtaactatgacatgatctgggtccgccaggctccagggaaggggctggaatccatcgggatgatttatgatgatggtgacacatactacgcgagttgggcgaaaggccgattcaccatctccaaaacctcgaccacggtggatctgaaaatcatcagtccgacaaccgaggacacggccacctatttctgtgtcaaaggtgtgagtaatcactggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 692 - DNA, 330 bp, Artificial
  Humanized antibody sequence
cagtcagtgaaggagtccgggggtcgcctggtcacgcctgggacacccctgacactcacctgcacagtctctggattctccctcagtaactatgacatgatctgggtccgccaggctccagggaaggggctggaatccatcgggatgatttatgatgatggtgacacatactacgcgagttgggcgaaaggccgattcaccatctccaaaacctcgaccacggtggatctgaaaatcatcagtccgacaaccgaggacacggccacctatttctgtgtcaaaggtgtgagtaatcactggggcccaggcaccctcgtcaccgtctcgagc

SEQ ID NO: 693 - DNA, 87 bp, Oryctolagus cuniculus
cagtcagtgaaggagtccgggggtcgcctggtcacgcctgggacacccctgacactcacctgcacagtctctggattctccctcagt

SEQ ID NO: 694 - DNA, 15 bp, Oryctolagus cuniculus
aactatgacatgatc

SEQ ID NO: 695 - DNA, 42 bp, Oryctolagus cuniculus
tgggtccgccaggctccagggaaggggctggaatccatcggg

SEQ ID NO: 696 - DNA, 48 bp, Oryctolagus cuniculus
atgatttatgatgatggtgacacatactacgcgagttgggcgaaaggc

SEQ ID NO: 697 - DNA, 90 bp, Oryctolagus cuniculus
cgattcaccatctccaaaacctcgaccacggtggatctgaaaatcatcagtccgacaaccgaggacacggccacctatttctgtgtcaaa

SEQ ID NO: 698 - DNA, 15 bp, Oryctolagus cuniculus
ggtgtgagtaatcac

SEQ ID NO: 699 - DNA, 33 bp, Artificial
  Humanized antibody sequence
tggggcccaggcaccctcgtcaccgtctcgagc

SEQ ID NO: 700 - DNA, 990 bp, Artificial; identical to SEQ ID NO: 20
  Humanized antibody sequence

SEQ ID NO: 701 - protein, 219 aa, Artificial
  Humanized antibody sequence
DVVMTQTPASVEAAVGGTVTIKCQASQSISSYLAWYQQKPGQPPKLLIYSASTLASGVPSRFKGRGSGTEFTLTISDLECADAATYYCQSYDGSSGSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 113 aa, Artificial
  Humanized antibody sequence
DVVMTQTPASVEAAVGGTVTIKCQASQSISSYLAWYQQKPGQPPKLLIYSASTLASGVPSRFKGRGSGTEFTLTISDLECADAATYYCQSYDGSSGSSYGVGFGGGTEVVVKR

SEQ ID NO: 703 - protein, 23 aa, Oryctolagus cuniculus
DVVMTQTPASVEAAVGGTVTIKC

SEQ ID NO: 704 - protein, 11 aa, Oryctolagus cuniculus
QASQSISSYLA

SEQ ID NO: 705 - protein, 15 aa, Oryctolagus cuniculus
WYQQKPGQPPKLLIY

SEQ ID NO: 706 - protein, 7 aa, Oryctolagus cuniculus
SASTLAS

SEQ ID NO: 707 - protein, 32 aa, Oryctolagus cuniculus
GVPSRFKGRGSGTEFTLTISDLECADAATYYC

SEQ ID NO: 708 - protein, 14 aa, Oryctolagus cuniculus
QSYDGSSGSSYGVG

SEQ ID NO: 709 - protein, 11 aa, Artificial
  Humanized antibody sequence
FGGGTEVVVKR

SEQ ID NO: 710 - protein, 106 aa, Artificial; identical to SEQ ID NO: 30
  Humanized antibody sequence

SEQ ID NO: 711 - DNA, 657 bp, Artificial
  Humanized antibody sequence
gatgttgtgatgacccagactccagcctccgtggaggcagctgtgggaggcacagtcaccatcaagtgccaggccagtcagagcattagtagttacttagcctggtatcagcagaaaccagggcagcctcccaaactcctgatctactctgcatccactctggcatctggggtcccatcgcggttcaaaggcaggggatctgggacagaattcactctcaccatcagcgacctggagtgtgccgatgctgccacttactactgtcaaagctatgatggtagtagtggtagtagttatggtgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 712 - DNA, 339 bp, Artificial
  Humanized antibody sequence
gatgttgtgatgacccagactccagcctccgtggaggcagctgtgggaggcacagtcaccatcaagtgccaggccagtcagagcattagtagttacttagcctggtatcagcagaaaccagggcagcctcccaaactcctgatctactctgcatccactctggcatctggggtcccatcgcggttcaaaggcaggggatctgggacagaattcactctcaccatcagcgacctggagtgtgccgatgctgccacttactactgtcaaagctatgatggtagtagtggtagtagttatggtgttggtttcggcggagggaccgaggtggtggtcaaacgt

SEQ ID NO: 713 - DNA, 69 bp, Oryctolagus cuniculus
gatgttgtgatgacccagactccagcctccgtggaggcagctgtgggaggcacagtcaccatcaagtgc

SEQ ID NO: 714 - DNA, 33 bp, Oryctolagus cuniculus; identical to SEQ ID NO: 154

SEQ ID NO: 715 - DNA, 45 bp, Oryctolagus cuniculus
tggtatcagcagaaaccagggcagcctcccaaactcctgatctac

SEQ ID NO: 716 - DNA, 21 bp, Oryctolagus cuniculus
tctgcatccactctggcatct

SEQ ID NO: 717 - DNA, 96 bp, Oryctolagus cuniculus
ggggtcccatcgcggttcaaaggcaggggatctgggacagaattcactctcaccatcagcgacctggagtgtgccgatgctgccacttactactgt

SEQ ID NO: 718 - DNA, 42 bp, Oryctolagus cuniculus; identical to SEQ ID NO: 158

SEQ ID NO: 719 - DNA, 33 bp, Artificial; identical to SEQ ID NO: 39
  Humanized antibody sequence

SEQ ID NO: 720 - DNA, 318 bp, Artificial; identical to SEQ ID NO: 40
  Humanized antibody sequence

SEQ ID NO: 721 - protein, 440 aa, Artificial
  Humanized antibody sequence
QSVEESGGRLVTPGTPLTLTCTVSGFSLSKYDMIWVRQAPGKGLESIGIIYDDGDTYYASWAKGRFTISQTSTTVDLKIISPTTEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 110 aa, Artificial
  Humanized antibody sequence
QSVEESGGRLVTPGTPLTLTCTVSGFSLSKYDMIWVRQAPGKGLESIGIIYDDGDTYYASWAKGRFTISQTSTTVDLKIISPTTEDTATYFCVKGVSNIWGQGTLVTVSS

SEQ ID NO: 723 - protein, 29 aa, Oryctolagus cuniculus
QSVEESGGRLVTPGTPLTLTCTVSGFSLS

SEQ ID NO: 724 - protein, 5 aa, Oryctolagus cuniculus
KYDMI

SEQ ID NO: 725 - protein, 14 aa, Oryctolagus cuniculus
WVRQAPGKGLESIG

SEQ ID NO: 726 - protein, 16 aa, Oryctolagus cuniculus
IIYDDGDTYYASWAKG

SEQ ID NO: 727 - protein, 30 aa, Oryctolagus cuniculus
RFTISQTSTTVDLKIISPTTEDTATYFCVK

SEQ ID NO: 728 - protein, 5 aa, Oryctolagus cuniculus
GVSNI

SEQ ID NO: 729 - protein, 11 aa, Artificial
  Humanized antibody sequence
WGQGTLVTVSS

SEQ ID NO: 730 - protein, 330 aa, Artificial; identical to SEQ ID NO: 10
  Humanized antibody sequence

SEQ ID NO: 731 - DNA, 1320 bp, Artificial
  Humanized antibody sequence
cagtcggtggaggagtccgggggtcgcctggtcacgcctgggacacccctgacactcacctgcacagtctctggattctccctcagtaagtatgacatgatctgggtccgccaggctccagggaaggggctggaatccatcgggatcatttatgatgatggcgacacatattacgcgagttgggcgaaaggccgattcaccatctcccaaacctcgaccacggtggatctgaaaatcatcagtccgacaaccgaggacacggccacctatttctgtgtcaaaggtgtgagtaatatctggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 732 - DNA, 330 bp, Artificial
  Humanized antibody sequence
cagtcggtggaggagtccgggggtcgcctggtcacgcctgggacacccctgacactcacctgcacagtctctggattctccctcagtaagtatgacatgatctgggtccgccaggctccagggaaggggctggaatccatcgggatcatttatgatgatggcgacacatattacgcgagttgggcgaaaggccgattcaccatctcccaaacctcgaccacggtggatctgaaaatcatcagtccgacaaccgaggacacggccacctatttctgtgtcaaaggtgtgagtaatatctggggccaaggcaccctcgtcaccgtctcgagc

SEQ ID NO: 733 - DNA, 87 bp, Oryctolagus cuniculus
cagtcggtggaggagtccgggggtcgcctggtcacgcctgggacacccctgacactcacctgcacagtctctggattctccctcagt

SEQ ID NO: 734 - DNA, 15 bp, Oryctolagus cuniculus
aagtatgacatgatc

SEQ ID NO: 735 - DNA, 42 bp, Oryctolagus cuniculus; identical to SEQ ID NO: 695

SEQ ID NO: 736 - DNA, 48 bp, Oryctolagus cuniculus
atcatttatgatgatggcgacacatattacgcgagttgggcgaaaggc

SEQ ID NO: 737 - DNA, 90 bp, Oryctolagus cuniculus
cgattcaccatctcccaaacctcgaccacggtggatctgaaaatcatcagtccgacaaccgaggacacggccacctatttctgtgtcaaa

SEQ ID NO: 738 - DNA, 15 bp, Oryctolagus cuniculus
ggtgtgagtaatatc

SEQ ID NO: 739 - DNA, 33 bp, Artificial
  Humanized antibody sequence
tggggccaaggcaccctcgtcaccgtctcgagc

SEQ ID NO: 740 - DNA, 990 bp, Artificial; identical to SEQ ID NO: 20
  Humanized antibody sequence

SEQ ID NO: 741 - protein, 219 aa, Artificial
  Humanized antibody sequence
DVVMTQTPASVEAAVGGTVTIKCQASQSISNYLAWYQQKTGQPPKLLIYSASTLASGVPSRFKGSGSGTEFTLTISDLECADAATYYCQSYEGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 113 aa, Artificial
  Humanized antibody sequence
DVVMTQTPASVEAAVGGTVTIKCQASQSISNYLAWYQQKTGQPPKLLIYSASTLASGVPSRFKGSGSGTEFTLTISDLECADAATYYCQSYEGSSSSSYGVGFGGGTEVVVKR

SEQ ID NO: 743 - protein, 23 aa, Oryctolagus cuniculus
DVVMTQTPASVEAAVGGTVTIKC

SEQ ID NO: 744 - protein, 11 aa, Oryctolagus cuniculus
QASQSISNYLA

SEQ ID NO: 745 - protein, 15 aa, Oryctolagus cuniculus
WYQQKTGQPPKLLIY

SEQ ID NO: 746 - protein, 7 aa, Oryctolagus cuniculus
SASTLAS

SEQ ID NO: 747 - protein, 32 aa, Oryctolagus cuniculus
GVPSRFKGSGSGTEFTLTISDLECADAATYYC

SEQ ID NO: 748 - protein, 14 aa, Oryctolagus cuniculus
QSYEGSSSSSYGVG

SEQ ID NO: 749 - protein, 11 aa, Artificial
  Humanized antibody sequence
FGGGTEVVVKR

SEQ ID NO: 750 - protein, 106 aa, Artificial; identical to SEQ ID NO: 30
  Humanized antibody sequence

SEQ ID NO: 751 - DNA, 657 bp, Artificial
  Humanized antibody sequence
gatgttgtgatgacccagactccagcctccgtggaggcagctgtgggaggcacagtcaccatcaagtgccaggccagtcagagcattagtaactacttagcctggtatcagcagaaaacagggcagcctcccaagctcctgatctactctgcatccactctggcatctggggtcccatcgcggttcaaaggcagtggatctgggacagagttcactctcaccatcagcgacctggagtgtgccgatgctgccacttactactgtcaaagctatgagggtagtagtagtagtagttatggtgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 752 - DNA, 339 bp, Artificial
  Humanized antibody sequence
gatgttgtgatgacccagactccagcctccgtggaggcagctgtgggaggcacagtcaccatcaagtgccaggccagtcagagcattagtaactacttagcctggtatcagcagaaaacagggcagcctcccaagctcctgatctactctgcatccactctggcatctggggtcccatcgcggttcaaaggcagtggatctgggacagagttcactctcaccatcagcgacctggagtgtgccgatgctgccacttactactgtcaaagctatgagggtagtagtagtagtagttatggtgttggtttcggcggagggaccgaggtggtggtcaaacgt

SEQ ID NO: 753 - DNA, 69 bp, Oryctolagus cuniculus; identical to SEQ ID NO: 713

SEQ ID NO: 754 - DNA, 33 bp, Oryctolagus cuniculus; identical to SEQ ID NO: 194

SEQ ID NO: 755 - DNA, 45 bp, Oryctolagus cuniculus
tggtatcagcagaaaacagggcagcctcccaagctcctgatctac

SEQ ID NO: 756 - DNA, 21 bp, Oryctolagus cuniculus
tctgcatccactctggcatct

SEQ ID NO: 757 - DNA, 96 bp, Oryctolagus cuniculus
ggggtcccatcgcggttcaaaggcagtggatctgggacagagttcactctcaccatcagcgacctggagtgtgccgatgctgccacttactactgt

SEQ ID NO: 758 - DNA, 42 bp, Oryctolagus cuniculus; identical to SEQ ID NO: 198

SEQ ID NO: 759 - DNA, 33 bp, Artificial; identical to SEQ ID NO: 39
  Humanized antibody sequence

SEQ ID NO: 760 - DNA, 318 bp, Artificial; identical to SEQ ID NO: 40
  Humanized antibody sequence

SEQ ID NO: 761 - protein, 441 aa, Artificial
  Humanized antibody sequence
QSLEESGGRLVTPGTPLTLTCTVSGSSLSNFDMIWVRQAPGKGLESIGIIYDFGSTYYASWAKGRFTISRTSSTTVDLKIISPTIEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 762 - protein, 111 aa, Artificial
  Humanized antibody sequence
QSLEESGGRLVTPGTPLTLTCTVSGSSLSNFDMIWVRQAPGKGLESIGIIYDFGSTYYASWAKGRFTISRTSSTTVDLKIISPTIEDTATYFCVKGVSNIWGQGTLVTVSS

SEQ ID NO: 763 - protein, 29 aa, Oryctolagus cuniculus
QSLEESGGRLVTPGTPLTLTCTVSGSSLS

SEQ ID NO: 764 - protein, 5 aa, Oryctolagus cuniculus
NFDMI

SEQ ID NO: 765 - protein, 14 aa, Oryctolagus cuniculus
WVRQAPGKGLESIG

SEQ ID NO: 766 - protein, 16 aa, Oryctolagus cuniculus
IIYDFGSTYYASWAKG

SEQ ID NO: 767 - protein, 31 aa, Oryctolagus cuniculus
RFTISRTSSTTVDLKIISPTIEDTATYFCVK

SEQ ID NO: 768 - protein, 5 aa, Oryctolagus cuniculus
GVSNI

SEQ ID NO: 769 - protein, 11 aa, Artificial
  Humanized antibody sequence
WGQGTLVTVSS

SEQ ID NO: 770 - protein, 330 aa, Artificial; identical to SEQ ID NO: 10
  Humanized antibody sequence

SEQ ID NO: 771 - DNA, 1323 bp, Artificial
  Humanized antibody sequence
cagtcgctggaggagtccgggggtcgcctggtcacgcctgggacacccctgacactcacctgcacagtctctggatcctccctcagtaattttgacatgatctgggtccgccaggctccagggaaggggctggaatccatcgggatcatttatgattttggtagcacatactacgcgagctgggcgaaaggccgcttcaccatctccagaacctcgtcgaccacggtggatctgaaaatcatcagtccgacaattgaggacacggccacctatttctgtgtcaaaggtgtgagtaatatctggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 772 - DNA, 333 bp, Artificial
  Humanized antibody sequence
cagtcgctggaggagtccgggggtcgcctggtcacgcctgggacacccctgacactcacctgcacagtctctggatcctccctcagtaattttgacatgatctgggtccgccaggctccagggaaggggctggaatccatcgggatcatttatgattttggtagcacatactacgcgagctgggcgaaaggccgcttcaccatctccagaacctcgtcgaccacggtggatctgaaaatcatcagtccgacaattgaggacacggccacctatttctgtgtcaaaggtgtgagtaatatctggggccaaggcaccctcgtcaccgtctcgagc

SEQ ID NO: 773 - DNA, 87 bp, Oryctolagus cuniculus
cagtcgctggaggagtccgggggtcgcctggtcacgcctgggacacccctgacactcacctgcacagtctctggatcctccctcagt

SEQ ID NO: 774 - DNA, 15 bp, Oryctolagus cuniculus
aattttgacatgatc

SEQ ID NO: 775 - DNA, 42 bp, Oryctolagus cuniculus; identical to SEQ ID NO: 695

SEQ ID NO: 776 - DNA, 48 bp, Oryctolagus cuniculus
atcatttatgattttggtagcacatactacgcgagctgggcgaaaggc

SEQ ID NO: 777 - DNA, 93 bp, Oryctolagus cuniculus
cgcttcaccatctccagaacctcgtcgaccacggtggatctgaaaatcatcagtccgacaattgaggacacggccacctatttctgtgtcaaa

SEQ ID NO: 778 - DNA, 15 bp, Oryctolagus cuniculus
ggtgtgagtaatatc

SEQ ID NO: 779 - DNA, 33 bp, Artificial; identical to SEQ ID NO: 739
  Humanized antibody sequence

SEQ ID NO: 780 - DNA, 990 bp, Artificial; identical to SEQ ID NO: 20
  Humanized antibody sequence

SEQ ID NO: 781 - protein, 219 aa, Artificial
  Humanized antibody sequence
DVVMTQTPASVEAAVGGTVTIKCQASEDISSNLAWYQQKLGQPPKLLIYSASTLASGVPSRFKGSGSGTEFTLAISDLECADAATYYCQSYDGSSSSSYGIGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 782 - protein, 113 aa, Artificial
  Humanized antibody sequence
DVVMTQTPASVEAAVGGTVTIKCQASEDISSNLAWYQQKLGQPPKLLIYSASTLASGVPSRFKGSGSGTEFTLAISDLECADAATYYCQSYDGSSSSSYGIGFGGGTEVVVKR

SEQ ID NO: 783 - protein, 23 aa, Oryctolagus cuniculus
DVVMTQTPASVEAAVGGTVTIKC

SEQ ID NO: 784 - protein, 11 aa, Oryctolagus cuniculus
QASEDISSNLA

SEQ ID NO: 785 - protein, 15 aa, Oryctolagus cuniculus
WYQQKLGQPPKLLIY

SEQ ID NO: 786 - protein, 7 aa, Oryctolagus cuniculus
SASTLAS

SEQ ID NO: 787 - protein, 32 aa, Oryctolagus cuniculus
GVPSRFKGSGSGTEFTLAISDLECADAATYYC

SEQ ID NO: 788 - protein, 14 aa, Oryctolagus cuniculus
QSYDGSSSSSYGIG

SEQ ID NO: 789 - protein, 11 aa, Artificial
  Humanized antibody sequence
FGGGTEVVVKR

SEQ ID NO: 790 - protein, 106 aa, Artificial; identical to SEQ ID NO: 30
  Humanized antibody sequence

SEQ ID NO: 791 - DNA, 657 bp, Artificial
  Humanized antibody sequence
gatgttgtgatgacccagactccagcctccgtggaggcagctgtgggaggcacagtcaccatcaagtgccaggccagtgaggatattagtagtaatttagcctggtatcagcagaaattagggcagcctcccaagctcctgatctactctgcatccactctggcatctggggtcccatcgcggttcaaaggcagtggatctgggacagagttcactctcgccatcagcgacctggagtgtgccgatgctgccacttactactgtcaaagctatgatggtagtagtagtagtagttatggtattggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 792 - DNA, 339 bp, Artificial
  Humanized antibody sequence
gatgttgtgatgacccagactccagcctccgtggaggcagctgtgggaggcacagtcaccatcaagtgccaggccagtgaggatattagtagtaatttagcctggtatcagcagaaattagggcagcctcccaagctcctgatctactctgcatccactctggcatctggggtcccatcgcggttcaaaggcagtggatctgggacagagttcactctcgccatcagcgacctggagtgtgccgatgctgccacttactactgtcaaagctatgatggtagtagtagtagtagttatggtattggtttcggcggagggaccgaggtggtggtcaaacgt

SEQ ID NO: 793 - DNA, 69 bp, Oryctolagus cuniculus; identical to SEQ ID NO: 713

SEQ ID NO: 794 - DNA, 33 bp, Oryctolagus cuniculus
caggccagtgaggatattagtagtaatttagcc

SEQ ID NO: 795 - DNA, 45 bp, Oryctolagus cuniculus
tggtatcagcagaaattagggcagcctcccaagctcctgatctac

SEQ ID NO: 796 - DNA, 21 bp, Oryctolagus cuniculus
tctgcatccactctggcatct

SEQ ID NO: 797 - DNA, 96 bp, Oryctolagus cuniculus
ggggtcccatcgcggttcaaaggcagtggatctgggacagagttcactctcgccatcagcgacctggagtgtgccgatgctgccacttactactgt

SEQ ID NO: 798 - DNA, 42 bp, Oryctolagus cuniculus; identical to SEQ ID NO: 238

SEQ ID NO: 799 - DNA, 33 bp, Artificial; identical to SEQ ID NO: 39
  Humanized antibody sequence

SEQ ID NO: 800 - DNA, 318 bp, Artificial; identical to SEQ ID NO: 40
  Humanized antibody sequence

SEQ ID NO: 801 - protein, 440 aa, Artificial
  Humanized antibody sequence
QSVEESGGRLVTPGTPLTLTYTVSGFSLSKHDMIWVRQAPGKGLESIGIIYDDGDTYYANWAKGRFTISKTSTTVDLKIISPTTEDTATYFCVKGVSNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 802 - protein, 110 aa, Artificial
  Humanized antibody sequence
QSVEESGGRLVTPGTPLTLTYTVSGFSLSKHDMIWVRQAPGKGLESIGIIYDDGDTYYANWAKGRFTISKTSTTVDLKIISPTTEDTATYFCVKGVSNIWGPGTLVTVSS

SEQ ID NO: 803 - protein, 29 aa, Oryctolagus cuniculus
QSVEESGGRLVTPGTPLTLTYTVSGFSLS

SEQ ID NO: 804 - protein, 5 aa, Oryctolagus cuniculus
KHDMI

SEQ ID NO: 805 - protein, 14 aa, Oryctolagus cuniculus
WVRQAPGKGLESIG

SEQ ID NO: 806 - protein, 16 aa, Oryctolagus cuniculus
IIYDDGDTYYANWAKG

SEQ ID NO: 807 - protein, 30 aa, Oryctolagus cuniculus; identical to SEQ ID NO: 687

SEQ ID NO: 808 - protein, 5 aa, Oryctolagus cuniculus
GVSNI

SEQ ID NO: 809 - protein, 11 aa, Artificial
  Humanized antibody sequence
WGPGTLVTVSS

SEQ ID NO: 810 - protein, 330 aa, Artificial; identical to SEQ ID NO: 10
  Humanized antibody sequence

SEQ ID NO: 811 - DNA, 1320 bp, Artificial
  Humanized antibody sequence
cagtcggtggaggagtccgggggtcgcctggtcacgcctgggacacccctgacactcacctacacagtctctggattctccctcagtaagcatgacatgatctgggtccgccaggctccagggaaggggctggaatccatcgggatcatttatgatgatggtgatacatactacgcgaattgggcgaaaggccgattcaccatctccaaaacctcgaccacggtggatctgaaaatcatcagtccgacaaccgaggacacggccacctatttctgtgtcaaaggtgtgagtaatatctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 812 - DNA, 330 bp, Artificial
  Humanized antibody sequence
cagtcggtggaggagtccgggggtcgcctggtcacgcctgggacacccctgacactcacctacacagtctctggattctccctcagtaagcatgacatgatctgggtccgccaggctccagggaaggggctggaatccatcgggatcatttatgatgatggtgatacatactacgcgaattgggcgaaaggccgattcaccatctccaaaacctcgaccacggtggatctgaaaatcatcagtccgacaaccgaggacacggccacctatttctgtgtcaaaggtgtgagtaatatctggggcccaggcaccctcgtcaccgtctcgagc

SEQ ID NO: 813 - DNA, 87 bp, Oryctolagus cuniculus
cagtcggtggaggagtccgggggtcgcctggtcacgcctgggacacccctgacactcacctacacagtctctggattctccctcagt

SEQ ID NO: 814 - DNA, 15 bp, Oryctolagus cuniculus
aagcatgacatgatc

SEQ ID NO: 815 - DNA, 42 bp, Oryctolagus cuniculus; identical to SEQ ID NO: 695

SEQ ID NO: 816 - DNA, 48 bp, Oryctolagus cuniculus
atcatttatgatgatggtgatacatactacgcgaattgggcgaaaggc

SEQ ID NO: 817 - DNA, 90 bp, Oryctolagus cuniculus; identical to SEQ ID NO: 697

SEQ ID NO: 818 - DNA, 15 bp, Oryctolagus cuniculus
ggtgtgagtaatatc

SEQ ID NO: 819 - DNA, 33 bp, Artificial; identical to SEQ ID NO: 699
  Humanized antibody sequence

SEQ ID NO: 820 - DNA, 990 bp, Artificial; identical to SEQ ID NO: 20
  Humanized antibody sequence

SEQ ID NO: 821 - protein, 219 aa, Artificial
  Humanized antibody sequence
DVVMTQTPASVEAAVGGTVTIKCRASQSISVYLAWYQQKAGQPPKLLIYQASKLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 113 aa, Artificial
  Humanized antibody sequence
DVVMTQTPASVEAAVGGTVTIKCRASQSISVYLAWYQQKAGQPPKLLIYQASKLASGVPSRFKGSGSGTEFTLTISDLECADAATYYCQSYDGSSSSSYGVGFGGGTEVVVKR

SEQ ID NO: 823 - protein, 23 aa, Oryctolagus cuniculus
DVVMTQTPASVEAAVGGTVTIKC

SEQ ID NO: 824 - protein, 11 aa, Oryctolagus cuniculus
RASQSISVYLA

SEQ ID NO: 825 - protein, 15 aa, Oryctolagus cuniculus
WYQQKAGQPPKLLIY

SEQ ID NO: 826 - protein, 7 aa, Oryctolagus cuniculus
QASKLAS

SEQ ID NO: 827 - protein, 32 aa, Oryctolagus cuniculus; identical to SEQ ID NO: 747

SEQ ID NO: 828 - protein, 14 aa, Oryctolagus cuniculus
QSYDGSSSSSYGVG

SEQ ID NO: 829 - protein, 11 aa, Artificial
  Humanized antibody sequence
FGGGTEVVVKR

SEQ ID NO: 830 - protein, 106 aa, Artificial; identical to SEQ ID NO: 30
  Humanized antibody sequence

SEQ ID NO: 831 - DNA, 657 bp, Artificial
  Humanized antibody sequence
gatgttgtgatgacccagactccagcctccgtggaggcagctgtgggaggcacagtcaccatcaagtgccgggccagtcagagcattagtgtctacctcgcctggtatcagcagaaagcagggcagcctcccaagctcctgatctaccaggcatccaaactggcctctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 832 - DNA, 339 bp, Artificial
  Humanized antibody sequence
gatgttgtgatgacccagactccagcctccgtggaggcagctgtgggaggcacagtcaccatcaagtgccgggccagtcagagcattagtgtctacctcgcctggtatcagcagaaagcagggcagcctcccaagctcctgatctaccaggcatccaaactggcctctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgt

SEQ ID NO: 833 - DNA, 69 bp, Oryctolagus cuniculus; identical to SEQ ID NO: 713

SEQ ID NO: 834 - DNA, 33 bp, Oryctolagus cuniculus
cgggccagtcagagcattagtgtctacctcgcc

SEQ ID NO: 835 - DNA, 45 bp, Oryctolagus cuniculus
tggtatcagcagaaagcagggcagcctcccaagctcctgatctac

SEQ ID NO: 836 - DNA, 21 bp, Oryctolagus cuniculus
caggcatccaaactggcctct

SEQ ID NO: 837 - DNA, 96 bp, Oryctolagus cuniculus; identical to SEQ ID NO: 757

SEQ ID NO: 838 - DNA, 42 bp, Oryctolagus cuniculus; identical to SEQ ID NO: 278

SEQ ID NO: 839 - DNA, 33 bp, Artificial; identical to SEQ ID NO: 39
  Humanized antibody sequence

SEQ ID NO: 840 - DNA, 318 bp, Artificial; identical to SEQ ID NO: 40
  Humanized antibody sequence

SEQ ID NO: 841 - protein, 451 aa, Artificial
  Humanized antibody sequence
QSVEESGGRLVTPGTPLTLTCTVSGFSLSSYAMSWVRQAPGEGLEWIGIISDSGSTYYASWAKGRFTISKTSTTVDLKITSPTTEDTATYFCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 842 - protein, 121 aa, Artificial
  Humanized antibody sequence
QSVEESGGRLVTPGTPLTLTCTVSGFSLSSYAMSWVRQAPGEGLEWIGIISDSGSTYYASWAKGRFTISKTSTTVDLKITSPTTEDTATYFCAREPEYGYDDYGDWVSDLWGQGTLVTVSS

SEQ ID NO: 843 - protein, 29 aa, Oryctolagus cuniculus
QSVEESGGRLVTPGTPLTLTCTVSGFSLS

SEQ ID NO: 844 - protein, 5 aa, Oryctolagus cuniculus
SYAMS

SEQ ID NO: 845 - protein, 14 aa, Oryctolagus cuniculus
WVRQAPGEGLEWIG

SEQ ID NO: 846 - protein, 16 aa, Oryctolagus cuniculus
IISDSGSTYYASWAKG

SEQ ID NO: 847 - protein, 30 aa, Oryctolagus cuniculus
RFTISKTSTTVDLKITSPTTEDTATYFCAR

SEQ ID NO: 848 - protein, 16 aa, Oryctolagus cuniculus
EPEYGYDDYGDWVSDL

SEQ ID NO: 849 - protein, 11 aa, Artificial
  Humanized antibody sequence
WGQGTLVTVSS

SEQ ID NO: 850 - protein, 330 aa, Artificial; identical to SEQ ID NO: 10
  Humanized antibody sequence

SEQ ID NO: 851 - DNA, 1353 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccaggggaggggctggaatggatcggaatcattagtgatagtggtagcacatactacgcgagctgggcgaaaggccgattcaccatctccaaaacctcgaccacggtggatctgaaaatcaccagtccgacaaccgaggacacggccacctatttctgtgccagagagcccgagtacggctacgatgactatggtgattgggtttctgacttatggggccagggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 852 - DNA, 363 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccaggggaggggctggaatggatcggaatcattagtgatagtggtagcacatactacgcgagctgggcgaaaggccgattcaccatctccaaaacctcgaccacggtggatctgaaaatcaccagtccgacaaccgaggacacggccacctatttctgtgccagagagcccgagtacggctacgatgactatggtgattgggtttctgacttatggggccagggcaccctggtcaccgtctcgagc

SEQ ID NO: 853 - DNA, 87 bp, Oryctolagus cuniculus; identical to SEQ ID NO: 733

SEQ ID NO: 854 - DNA, 15 bp, Oryctolagus cuniculus
agctatgcaatgagc

SEQ ID NO: 855 - DNA, 42 bp, Oryctolagus cuniculus
tgggtccgccaggctccaggggaggggctggaatggatcgga

SEQ ID NO: 856 - DNA, 48 bp, Oryctolagus cuniculus
atcattagtgatagtggtagcacatactacgcgagctgggcgaaaggc

SEQ ID NO: 857 - DNA, 90 bp, Oryctolagus cuniculus
cgattcaccatctccaaaacctcgaccacggtggatctgaaaatcaccagtccgacaaccgaggacacggccacctatttctgtgccaga

SEQ ID NO: 858 - DNA, 48 bp, Oryctolagus cuniculus; identical to SEQ ID NO: 338

SEQ ID NO: 859 - DNA, 33 bp, Artificial
  Humanized antibody sequence
tggggccagggcaccctggtcaccgtctcgagc

SEQ ID NO: 860 - DNA, 990 bp, Artificial; identical to SEQ ID NO: 20
  Humanized antibody sequence

SEQ ID NO: 861 - protein, 220 aa, Artificial
  Humanized antibody sequence
ADIVMTQTPASVSEPVGGTVTIKCQASQSISSYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 114 aa, Artificial
  Humanized antibody sequence
ADIVMTQTPASVSEPVGGTVTIKCQASQSISSYLSWYQQKPGQPPKLLIYRASTLASGVPSRFKGSGSGTQFTLTISDLECADAATYYCQSYYYSSSITYRNAFGGGTEVVVKR

SEQ ID NO: 863 - protein, 24 aa, Oryctolagus cuniculus
ADIVMTQTPASVSEPVGGTVTIKC

SEQ ID NO: 864 - protein, 11 aa, Oryctolagus cuniculus
QASQSISSYLS

SEQ ID NO: 865 - protein, 15 aa, Oryctolagus cuniculus
WYQQKPGQPPKLLIY

SEQ ID NO: 866 - protein, 7 aa, Oryctolagus cuniculus
RASTLAS

SEQ ID NO: 867 - protein, 32 aa, Oryctolagus cuniculus
GVPSRFKGSGSGTQFTLTISDLECADAATYYC

SEQ ID NO: 868 - protein, 14 aa, Oryctolagus cuniculus
QSYYYSSSITYRNA

SEQ ID NO: 869 - protein, 11 aa, Artificial
  Humanized antibody sequence
FGGGTEVVVKR

SEQ ID NO: 870 - protein, 106 aa, Artificial; identical to SEQ ID NO: 30
  Humanized antibody sequence

SEQ ID NO: 871 - DNA, 660 bp, Artificial
  Humanized antibody sequence
gctgacattgtgatgacccagactccagcctccgtgtctgaacctgtgggaggcacagtcaccatcaagtgccaggccagtcagagcattagtagttacttatcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 872 - DNA, 342 bp, Artificial
  Humanized antibody sequence
gctgacattgtgatgacccagactccagcctccgtgtctgaacctgtgggaggcacagtcaccatcaagtgccaggccagtcagagcattagtagttacttatcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgt

SEQ ID NO: 873 - DNA, 72 bp, Oryctolagus cuniculus
gctgacattgtgatgacccagactccagcctccgtgtctgaacctgtgggaggcacagtcaccatcaagtgc

SEQ ID NO: 874 - DNA, 33 bp, Oryctolagus cuniculus
caggccagtcagagcattagtagttacttatcc

SEQ ID NO: 875 - DNA, 45 bp, Oryctolagus cuniculus
tggtatcagcagaaaccagggcagcctcccaagctcctgatctac

SEQ ID NO: 876 - DNA, 21 bp, Oryctolagus cuniculus
agggcatccactctggcatct

SEQ ID NO: 877 - DNA, 96 bp, Oryctolagus cuniculus
ggggtcccatcgcggttcaaaggcagtggatctgggacacagttcactctcaccatcagcgacctggagtgtgccgatgctgccacttactactgt

SEQ ID NO: 878 - DNA, 42 bp, Oryctolagus cuniculus
caaagctattattatagtagtagtattacttatcgtaatgct

SEQ ID NO: 879 - DNA, 33 bp, Artificial; identical to SEQ ID NO: 39
  Humanized antibody sequence

SEQ ID NO: 880 - DNA, 318 bp, Artificial; identical to SEQ ID NO: 40
  Humanized antibody sequence

SEQ ID NO: 881 - protein, 451 aa, Artificial
  Humanized antibody sequence
QSVEESGGRLVTPGTPLTLTCTVSGFSLTDYAMSWVRQAPGEGLEWIGIISDSGSTYYASWAKGRFTFSKTSTTVDLRITSPTTEDTATYFCAREPEYGYDEYGDWVSDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 121 aa, Artificial
  Humanized antibody sequence
QSVEESGGRLVTPGTPLTLTCTVSGFSLTDYAMSWVRQAPGEGLEWIGIISDSGSTYYASWAKGRFTFSKTSTTVDLRITSPTTEDTATYFCAREPEYGYDEYGDWVSDLWGPGTLVTVSS

SEQ ID NO: 883 - protein, 29 aa, Oryctolagus cuniculus
QSVEESGGRLVTPGTPLTLTCTVSGFSLT

SEQ ID NO: 884 - protein, 5 aa, Oryctolagus cuniculus
DYAMS

SEQ ID NO: 885 - protein, 14 aa, Oryctolagus cuniculus
WVRQAPGEGLEWIG

SEQ ID NO: 886 - protein, 16 aa, Oryctolagus cuniculus
IISDSGSTYYASWAKG

SEQ ID NO: 887 - protein, 30 aa, Oryctolagus cuniculus
RFTFSKTSTTVDLRITSPTTEDTATYFCAR

SEQ ID NO: 888 - protein, 16 aa, Oryctolagus cuniculus
EPEYGYDEYGDWVSDL

SEQ ID NO: 889 - protein, 11 aa, Artificial
  Humanized antibody sequence
WGPGTLVTVSS

SEQ ID NO: 890 - protein, 330 aa, Artificial; identical to SEQ ID NO: 10
  Humanized antibody sequence

SEQ ID NO: 891 - DNA, 1353 bp, Artificial
  Humanized antibody sequence
cagtcggtggaggagtccgggggtcgcctggtcacgcctgggacacccctgacactcacctgcacagtctctggattctccctcactgactatgcaatgagctgggtccgccaggctccaggggaggggctggaatggatcggaatcattagtgatagtggtagcacatactacgcgagctgggcgaaaggccgattcaccttctccaaaacctcgaccacggtggatctgagaatcaccagtccgaccaccgaggacacggccacctatttctgtgccagagagcccgagtacggctacgatgagtatggtgattgggtttctgacttatggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 892 - DNA, 363 bp, Artificial
  Humanized antibody sequence
cagtcggtggaggagtccgggggtcgcctggtcacgcctgggacacccctgacactcacctgcacagtctctggattctccctcactgactatgcaatgagctgggtccgccaggctccaggggaggggctggaatggatcggaatcattagtgatagtggtagcacatactacgcgagctgggcgaaaggccgattcaccttctccaaaacctcgaccacggtggatctgagaatcaccagtccgaccaccgaggacacggccacctatttctgtgccagagagcccgagtacggctacgatgagtatggtgattgggtttctgacttatggggcccaggcaccctcgtcaccgtctcgagc

SEQ ID NO: 893 - DNA, 87 bp, Oryctolagus cuniculus
cagtcggtggaggagtccgggggtcgcctggtcacgcctgggacacccctgacactcacctgcacagtctctggattctccctcact

SEQ ID NO: 894 - DNA, 15 bp, Oryctolagus cuniculus
gactatgcaatgagc

SEQ ID NO: 895 - DNA, 42 bp, Oryctolagus cuniculus; identical to SEQ ID NO: 855

SEQ ID NO: 896 - DNA, 48 bp, Oryctolagus cuniculus; identical to SEQ ID NO: 856

SEQ ID NO: 897 - DNA, 90 bp, Oryctolagus cuniculus
cgattcaccttctccaaaacctcgaccacggtggatctgagaatcaccagtccgaccaccgaggacacggccacctatttctgtgccaga

SEQ ID NO: 898 - DNA, 48 bp, Oryctolagus cuniculus; identical to SEQ ID NO: 298

SEQ ID NO: 899 - DNA, 33 bp, Artificial; identical to SEQ ID NO: 699
  Humanized antibody sequence

SEQ ID NO: 900 - DNA, 990 bp, Artificial; identical to SEQ ID NO: 20
  Humanized antibody sequence

SEQ ID NO: 901 - protein, 220 aa, Artificial
  Humanized antibody sequence
ADIVMTQTPASVEAAVGGAVTIKCQATQSIGNNLAWYQQKPGQPPKLLIYRASTLASGVPSRFKGSGSGTEFTLTISDLECADAATYYCQSYYYSSSITYHNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 902 - protein, 114 aa, Artificial
  Humanized antibody sequence
ADIVMTQTPASVEAAVGGAVTIKCQATQSIGNNLAWYQQKPGQPPKLLIYRASTLASGVPSRFKGSGSGTEFTLTISDLECADAATYYCQSYYYSSSITYHNAFGGGTEVVVKR

SEQ ID NO: 903 - protein, 24 aa, Oryctolagus cuniculus
ADIVMTQTPASVEAAVGGAVTIKC

SEQ ID NO: 904 - protein, 11 aa, Oryctolagus cuniculus
QATQSIGNNLA

SEQ ID NO: 905 - protein, 15 aa, Oryctolagus cuniculus
WYQQKPGQPPKLLIY

SEQ ID NO: 906 - protein, 7 aa, Oryctolagus cuniculus
RASTLAS

SEQ ID NO: 907 - protein, 32 aa, Oryctolagus cuniculus; identical to SEQ ID NO: 747

SEQ ID NO: 908 - protein, 14 aa, Oryctolagus cuniculus
QSYYYSSSITYHNA

SEQ ID NO: 909 - protein, 11 aa, Artificial
  Humanized antibody sequence
FGGGTEVVVKR

SEQ ID NO: 910 - protein, 106 aa, Artificial; identical to SEQ ID NO: 30
  Humanized antibody sequence

SEQ ID NO: 911 - DNA, 660 bp, Artificial
  Humanized antibody sequence
gctgacattgtgatgacccagactccagcctccgtggaggcagctgtgggaggcgcagtcaccatcaagtgccaggccactcagagcattggtaataatttagcctggtatcagcagaaaccagggcagcctcccaagctcctgatctacagggcatccactctggcatctggggtcccatcgcggttcaaaggcagtgggtctgggacagagttcactctcaccatcagcgacctggagtgtgccgatgctgccacttactactgtcaaagctattattatagtagtagtattacttatcataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 912 - DNA, 342 bp, Artificial
  Humanized antibody sequence
gctgacattgtgatgacccagactccagcctccgtggaggcagctgtgggaggcgcagtcaccatcaagtgccaggccactcagagcattggtaataatttagcctggtatcagcagaaaccagggcagcctcccaagctcctgatctacagggcatccactctggcatctggggtcccatcgcggttcaaaggcagtgggtctgggacagagttcactctcaccatcagcgacctggagtgtgccgatgctgccacttactactgtcaaagctattattatagtagtagtattacttatcataatgctttcggcggagggaccgaggtggtggtcaaacgt

SEQ ID NO: 913 - DNA, 72 bp, Oryctolagus cuniculus
gctgacattgtgatgacccagactccagcctccgtggaggcagctgtgggaggcgcagtcaccatcaagtgc

SEQ ID NO: 914 - DNA, 33 bp, Oryctolagus cuniculus
caggccactcagagcattggtaataatttagcc

SEQ ID NO: 915 - DNA, 45 bp, Oryctolagus cuniculus; identical to SEQ ID NO: 875

SEQ ID NO: 916 - DNA, 21 bp, Oryctolagus cuniculus
agggcatccactctggcatct

SEQ ID NO: 917 - DNA, 96 bp, Oryctolagus cuniculus
ggggtcccatcgcggttcaaaggcagtgggtctgggacagagttcactctcaccatcagcgacctggagtgtgccgatgctgccacttactactgt

SEQ ID NO: 918 - DNA, 42 bp, Oryctolagus cuniculus
caaagctattattatagtagtagtattacttatcataatgct

SEQ ID NO: 919 - DNA, 33 bp, Artificial; identical to SEQ ID NO: 39
  Humanized antibody sequence

SEQ ID NO: 920 - DNA, 318 bp, Artificial; identical to SEQ ID NO: 40
  Humanized antibody sequence

SEQ ID NO: 921 - protein, 451 aa, Artificial
  Humanized antibody sequence
QSVEESGGRLVTPGTPLTLTCTVSGFSLSSYAMSWVRQAPGEGLEWIGIISDSGSTYYASWAKGRFTISKTSTTVDLRITSPTTEDTATYFCAREPEYGYDDYGDWVSDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 922 - protein, 121 aa, Artificial
  Humanized antibody sequence
QSVEESGGRLVTPGTPLTLTCTVSGFSLSSYAMSWVRQAPGEGLEWIGIISDSGSTYYASWAKGRFTISKTSTTVDLRITSPTTEDTATYFCAREPEYGYDDYGDWVSDLWGQGTLVTVSS

SEQ ID NO: 923 - protein, 29 aa, Oryctolagus cuniculus
QSVEESGGRLVTPGTPLTLTCTVSGFSLS

SEQ ID NO: 924 - protein, 5 aa, Oryctolagus cuniculus
SYAMS

SEQ ID NO: 925 - protein, 14 aa, Oryctolagus cuniculus
WVRQAPGEGLEWIG

SEQ ID NO: 926 - protein, 16 aa, Oryctolagus cuniculus
IISDSGSTYYASWAKG

SEQ ID NO: 927 - protein, 30 aa, Oryctolagus cuniculus
RFTISKTSTTVDLRITSPTTEDTATYFCAR

SEQ ID NO: 928 - protein, 16 aa, Oryctolagus cuniculus
EPEYGYDDYGDWVSDL

SEQ ID NO: 929 - protein, 11 aa, Artificial
  Humanized antibody sequence
WGQGTLVTVSS

SEQ ID NO: 930 - protein, 330 aa, Artificial; identical to SEQ ID NO: 10
  Humanized antibody sequence

SEQ ID NO: 931 - DNA, 1353 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccaggggaggggctggaatggatcggaatcattagtgatagtggtagcacatactacgcgagctgggcgaaaggccgattcaccatctccaaaacctcgaccacggtggatctgagaatcaccagtccgacaaccgaggacacggccacctatttctgtgccagagagcccgagtacggctacgatgactatggtgattgggtttctgacttatggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 932 - DNA, 363 bp, Artificial
  Humanized antibody sequence
cagtcggtggaggagtccgggggtcgcctggtcacgcctgggacacccctgacactcacctgcacagtctctggattctccctcagtagctatgcaatgagctgggtccgccaggctccaggggaggggctggaatggatcggaatcattagtgatagtggtagcacatactacgcgagctgggcgaaaggccgattcaccatctccaaaacctcgaccacggtggatctgagaatcaccagtccgacaaccgaggacacggccacctatttctgtgccagagagcccgagtacggctacgatgactatggtgattgggtttctgacttatggggccaaggcaccctcgtcaccgtctcgagc

SEQ ID NO: 933 - DNA, 87 bp, Oryctolagus cuniculus; identical to SEQ ID NO: 733

SEQ ID NO: 934 - DNA, 15 bp, Oryctolagus cuniculus
agctatgcaatgagc

SEQ ID NO: 935 - DNA, 42 bp, Oryctolagus cuniculus; identical to SEQ ID NO: 855

SEQ ID NO: 936 - DNA, 48 bp, Oryctolagus cuniculus; identical to SEQ ID NO: 856

SEQ ID NO: 937 - DNA, 90 bp, Oryctolagus cuniculus
cgattcaccatctccaaaacctcgaccacggtggatctgagaatcaccagtccgacaaccgaggacacggccacctatttctgtgccaga

SEQ ID NO: 938 - DNA, 48 bp, Oryctolagus cuniculus; identical to SEQ ID NO: 338

SEQ ID NO: 939 - DNA, 33 bp, Artificial; identical to SEQ ID NO: 739
  Humanized antibody sequence

SEQ ID NO: 940 - DNA, 990 bp, Artificial; identical to SEQ ID NO: 20
  Humanized antibody sequence

SEQ ID NO: 941 - protein, 220 aa, Artificial
  Humanized antibody sequence
ADIVMTQTPASVEAAVGGTVTIKCQASQSISDYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 942 - protein, 114 aa, Artificial
  Humanized antibody sequence
ADIVMTQTPASVEAAVGGTVTIKCQASQSISDYLSWYQQKPGQPPKLLIYRASTLASGVPSRFKGSGSGTQFTLTISDLECADAATYYCQSYYYSSSITYRNAFGGGTEVVVKR

SEQ ID NO: 943 - protein, 24 aa, Oryctolagus cuniculus
ADIVMTQTPASVEAAVGGTVTIKC

SEQ ID NO: 944 - protein, 11 aa, Oryctolagus cuniculus
QASQSISDYLS

SEQ ID NO: 945 - protein, 15 aa, Oryctolagus cuniculus
WYQQKPGQPPKLLIY

SEQ ID NO: 946 - protein, 7 aa, Oryctolagus cuniculus
RASTLAS

SEQ ID NO: 947 - protein, 32 aa, Oryctolagus cuniculus; identical to SEQ ID NO: 867

SEQ ID NO: 948 - protein, 14 aa, Oryctolagus cuniculus
QSYYYSSSITYRNA

SEQ ID NO: 949 - protein, 11 aa, Artificial
  Humanized antibody sequence
FGGGTEVVVKR

SEQ ID NO: 950 - protein, 106 aa, Artificial; identical to SEQ ID NO: 30
  Humanized antibody sequence

SEQ ID NO: 951 - DNA, 660 bp, Artificial
  Humanized antibody sequence
gctgacattgtgatgacccagactccagcctccgtggaggcagctgtgggaggcacagtcaccatcaagtgccaggccagtcagagcattagtgattacttatcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 952 - DNA, 342 bp, Artificial
  Humanized antibody sequence
gctgacattgtgatgacccagactccagcctccgtggaggcagctgtgggaggcacagtcaccatcaagtgccaggccagtcagagcattagtgattacttatcctggtatcagcagaaaccagggcagcctcccaagctcctgatctacagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgt

SEQ ID NO: 953 - DNA, 72 bp, Oryctolagus cuniculus
gctgacattgtgatgacccagactccagcctccgtggaggcagctgtgggaggcacagtcaccatcaagtgc

SEQ ID NO: 954 - DNA, 33 bp, Oryctolagus cuniculus; identical to SEQ ID NO: 354

SEQ ID NO: 955 - DNA, 45 bp, Oryctolagus cuniculus; identical to SEQ ID NO: 875

SEQ ID NO: 956 - DNA, 21 bp, Oryctolagus cuniculus
agggcatccactctggcatct

SEQ ID NO: 957 - DNA, 96 bp, Oryctolagus cuniculus; identical to SEQ ID NO: 877

SEQ ID NO: 958 - DNA, 42 bp, Oryctolagus cuniculus; identical to SEQ ID NO: 878

SEQ ID NO: 959 - DNA, 33 bp, Artificial; identical to SEQ ID NO: 39
  Humanized antibody sequence

SEQ ID NO: 960 - DNA, 318 bp, Artificial; identical to SEQ ID NO: 40
  Humanized antibody sequence

SEQ ID NO: 961 - protein, 451 aa, Artificial
  Humanized antibody sequence
QSVEESGGRLVTPGTPLTLTCTVSGFSLNSYAMSWVRQAPGEGLEWIGIISDSGRTYYASWAKGRFTISKTSTTVDLKITSPTTEDTATYFCAREPEYGYDDYGDWVSDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 962 - protein, 121 aa, Artificial
  Humanized antibody sequence
QSVEESGGRLVTPGTPLTLTCTVSGFSLNSYAMSWVRQAPGEGLEWIGIISDSGRTYYASWAKGRFTISKTSTTVDLKITSPTTEDTATYFCAREPEYGYDDYGDWVSDLWGPGTLVTVSS

SEQ ID NO: 963 - protein, 29 aa, Oryctolagus cuniculus
QSVEESGGRLVTPGTPLTLTCTVSGFSLN

SEQ ID NO: 964 - protein, 5 aa, Oryctolagus cuniculus
SYAMS

SEQ ID NO: 965 - protein, 14 aa, Oryctolagus cuniculus
WVRQAPGEGLEWIG

SEQ ID NO: 966 - protein, 16 aa, Oryctolagus cuniculus
IISDSGRTYYASWAKG

SEQ ID NO: 967 - protein, 30 aa, Oryctolagus cuniculus; identical to SEQ ID NO: 847

SEQ ID NO: 968 - protein, 16 aa, Oryctolagus cuniculus
EPEYGYDDYGDWVSDL

SEQ ID NO: 969 - protein, 11 aa, Artificial
  Humanized antibody sequence
WGPGTLVTVSS

SEQ ID NO: 970 - protein, 330 aa, Artificial; identical to SEQ ID NO: 10
  Humanized antibody sequence

SEQ ID NO: 971 - DNA, 1353 bp, Artificial
  Humanized antibody sequence
cagtcggtggaggagtccgggggtcgcctggtcacgcctgggacacccctgacactcacctgcacagtctctggattctccctcaatagttatgcaatgagctgggtccgccaggctccaggggaggggctggaatggatcggaatcattagtgatagtggtaggacatactacgcgagctgggcgaaaggccgattcaccatctccaaaacctcgaccacggtggatctgaaaatcaccagtccgacaaccgaggacacggccacctatttctgtgccagagagcccgagtacggctacgatgactatggtgattgggtttctgacttatggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 972 - DNA, 363 bp, Artificial
  Humanized antibody sequence
cagtcggtggaggagtccgggggtcgcctggtcacgcctgggacacccctgacactcacctgcacagtctctggattctccctcaatagttatgcaatgagctgggtccgccaggctccaggggaggggctggaatggatcggaatcattagtgatagtggtaggacatactacgcgagctgggcgaaaggccgattcaccatctccaaaacctcgaccacggtggatctgaaaatcaccagtccgacaaccgaggacacggccacctatttctgtgccagagagcccgagtacggctacgatgactatggtgattgggtttctgacttatggggcccaggcaccctcgtcaccgtctcgagc

SEQ ID NO: 973 - DNA, 87 bp, Oryctolagus cuniculus
cagtcggtggaggagtccgggggtcgcctggtcacgcctgggacacccctgacactcacctgcacagtctctggattctccctcaat

SEQ ID NO: 974 - DNA, 15 bp, Oryctolagus cuniculus
agttatgcaatgagc

SEQ ID NO: 975 - DNA, 42 bp, Oryctolagus cuniculus; identical to SEQ ID NO: 855

SEQ ID NO: 976 - DNA, 48 bp, Oryctolagus cuniculus
atcattagtgatagtggtaggacatactacgcgagctgggcgaaaggc

SEQ ID NO: 977 - DNA, 90 bp, Oryctolagus cuniculus; identical to SEQ ID NO: 857

SEQ ID NO: 978 - DNA, 48 bp, Oryctolagus cuniculus; identical to SEQ ID NO: 338

SEQ ID NO: 979 - DNA, 33 bp, Artificial; identical to SEQ ID NO: 699
  Humanized antibody sequence

SEQ ID NO: 980 - DNA, 990 bp, Artificial; identical to SEQ ID NO: 20
  Humanized antibody sequence

SEQ ID NO: 981 - protein, 220 aa, Artificial
  Humanized antibody sequence
ADVVMTQTPASVEAAVGGTVTIKCQASQSISSYLSWYQQKPGQPPKLLIYRASTLASGVPSRFKGSGSGTQFTLTISDLECADAATYYCQSYYYSSSITYRNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - protein, 114 aa, Artificial
  Humanized antibody sequence
ADVVMTQTPASVEAAVGGTVTIKCQASQSISSYLSWYQQKPGQPPKLLIYRASTLASGVPSRFKGSGSGTQFTLTISDLECADAATYYCQSYYYSSSITYRNAFGGGTEVVVKR

SEQ ID NO: 983 - protein, 24 aa, Oryctolagus cuniculus
ADVVMTQTPASVEAAVGGTVTIKC

SEQ ID NO: 984 - protein, 11 aa, Oryctolagus cuniculus
QASQSISSYLS

SEQ ID NO: 985 - protein, 15 aa, Oryctolagus cuniculus
WYQQKPGQPPKLLIY

SEQ ID NO: 986 - protein, 7 aa, Oryctolagus cuniculus
RASTLAS

SEQ ID NO: 987 - protein, 32 aa, Oryctolagus cuniculus; identical to SEQ ID NO: 867

SEQ ID NO: 988 - protein, 14 aa, Oryctolagus cuniculus
QSYYYSSSITYRNA

SEQ ID NO: 989 - protein, 11 aa, Artificial
  Humanized antibody sequence
FGGGTEVVVKR

SEQ ID NO: 990 - protein, 106 aa, Artificial; identical to SEQ ID NO: 30
  Humanized antibody sequence

SEQ ID NO: 991 - DNA, 660 bp, Artificial
  Humanized antibody sequence
gctgacgttgtgatgacccagactccagcctccgtggaggctgctgtgggaggcacagtcaccatcaagtgccaggccagtcagagcattagtagttacttatcctggtatcagcagaaaccagggcagcctcccaagctcctgatctatagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 992 - DNA, 342 bp, Artificial
  Humanized antibody sequence
gctgacgttgtgatgacccagactccagcctccgtggaggctgctgtgggaggcacagtcaccatcaagtgccaggccagtcagagcattagtagttacttatcctggtatcagcagaaaccagggcagcctcccaagctcctgatctatagggcatccactctggcatctggggtcccatcgcggttcaaaggcagtggatctgggacacagttcactctcaccatcagcgacctggagtgtgccgatgctgccacttactactgtcaaagctattattatagtagtagtattacttatcgtaatgctttcggcggagggaccgaggtggtggtcaaacgt

SEQ ID NO: 993 - DNA, 72 bp, Oryctolagus cuniculus
gctgacgttgtgatgacccagactccagcctccgtggaggctgctgtgggaggcacagtcaccatcaagtgc

SEQ ID NO: 994 - DNA, 33 bp, Oryctolagus cuniculus; identical to SEQ ID NO: 874

SEQ ID NO: 995 - DNA, 45 bp, Oryctolagus cuniculus; identical to SEQ ID NO: 35

SEQ ID NO: 996 - DNA, 21 bp, Oryctolagus cuniculus
agggcatccactctggcatct

SEQ ID NO: 997 - DNA, 96 bp, Oryctolagus cuniculus; identical to SEQ ID NO: 877

SEQ ID NO: 998 - DNA, 42 bp, Oryctolagus cuniculus; identical to SEQ ID NO: 878

SEQ ID NO: 999 - DNA, 33 bp, Artificial; identical to SEQ ID NO: 39
  Humanized antibody sequence

SEQ ID NO: 1000 - DNA, 318 bp, Artificial; identical to SEQ ID NO: 40
  Humanized antibody sequence

SEQ ID NO: 1001 - protein, 440 aa, Artificial
  Humanized antibody sequence
QSVEESGGRLVTPGTPLTLTCTVSGFSLSSADMIWVRQAPGKGLESIGMIYDDGDTYYATWAKGRFTISKTSTTVDLKIISPTTEDTATYFCVKGVSSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1002 - protein, 110 aa, Artificial
  Humanized antibody sequence
QSVEESGGRLVTPGTPLTLTCTVSGFSLSSADMIWVRQAPGKGLESIGMIYDDGDTYYATWAKGRFTISKTSTTVDLKIISPTTEDTATYFCVKGVSSVWGQGTLVTVSS

SEQ ID NO: 1003 - protein, 29 aa, Oryctolagus cuniculus
QSVEESGGRLVTPGTPLTLTCTVSGFSLS

SEQ ID NO: 1004 - protein, 5 aa, Oryctolagus cuniculus
SADMI

SEQ ID NO: 1005 - protein, 14 aa, Oryctolagus cuniculus
WVRQAPGKGLESIG

SEQ ID NO: 1006 - protein, 16 aa, Oryctolagus cuniculus
MIYDDGDTYYATWAKG

SEQ ID NO: 1007 - protein, 30 aa, Oryctolagus cuniculus; identical to SEQ ID NO: 687

SEQ ID NO: 1008 - protein, 5 aa, Oryctolagus cuniculus
GVSSV

SEQ ID NO: 1009 - protein, 11 aa, Artificial
  Humanized antibody sequence
WGQGTLVTVSS

SEQ ID NO: 1010 - protein, 330 aa, Artificial; identical to SEQ ID NO: 10
  Humanized antibody sequence

SEQ ID NO: 1011 - DNA, 1320 bp, Artificial
  Humanized antibody sequence
cagtcggtggaggagtccgggggtcgcctggtcacgcctgggacacccctgacactcacctgcacagtctctggattctccctcagtagcgctgacatgatctgggtccgccaggctccagggaaggggctggaatccatcgggatgatttatgatgatggtgacacatactacgcgacttgggcgaaaggccgattcaccatctccaaaacctcgaccacggtggatctgaagatcatcagtccgacaaccgaggacacggccacctatttctgtgtcaaaggtgtgagtagtgtctggggccaggggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1012 - DNA, 330 bp, Artificial
  Humanized antibody sequence
cagtcggtggaggagtccgggggtcgcctggtcacgcctgggacacccctgacactcacctgcacagtctctggattctccctcagtagcgctgacatgatctgggtccgccaggctccagggaaggggctggaatccatcgggatgatttatgatgatggtgacacatactacgcgacttgggcgaaaggccgattcaccatctccaaaacctcgaccacggtggatctgaagatcatcagtccgacaaccgaggacacggccacctatttctgtgtcaaaggtgtgagtagtgtctggggccaggggaccctggtcaccgtctcgagc

SEQ ID NO: 1013 - DNA, 87 bp, Oryctolagus cuniculus; identical to SEQ ID NO: 733

SEQ ID NO: 1014 - DNA, 15 bp, Oryctolagus cuniculus
agcgctgacatgatc

SEQ ID NO: 1015 - DNA, 42 bp, Oryctolagus cuniculus; identical to SEQ ID NO: 695

SEQ ID NO: 1016 - DNA, 48 bp, Oryctolagus cuniculus
atgatttatgatgatggtgacacatactacgcgacttgggcgaaaggc

SEQ ID NO: 1017 - DNA, 90 bp, Oryctolagus cuniculus
cgattcaccatctccaaaacctcgaccacggtggatctgaagatcatcagtccgacaaccgaggacacggccacctatttctgtgtcaaa

SEQ ID NO: 1018 - DNA, 15 bp, Oryctolagus cuniculus
ggtgtgagtagtgtc

SEQ ID NO: 1019 - DNA, 33 bp, Artificial
  Humanized antibody sequence
tggggccaggggaccctggtcaccgtctcgagc

SEQ ID NO: 1020 - DNA, 990 bp, Artificial; identical to SEQ ID NO: 20
  Humanized antibody sequence

SEQ ID NO: 1021 - protein, 219 aa, Artificial
  Humanized antibody sequence
DVVMTQTPASVEAAVGGTVTINCQASENIYRSLAWYQQKPGQPPKLLIYSASTLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1022 - protein, 113 aa, Artificial
  Humanized antibody sequence
DVVMTQTPASVEAAVGGTVTINCQASENIYRSLAWYQQKPGQPPKLLIYSASTLASGVPSRFKGSGSGTEFTLTISDLECADAATYYCQSYDGSSSSSYGVGFGGGTEVVVKR

SEQ ID NO: 1023 - protein, 23 aa, Oryctolagus cuniculus
DVVMTQTPASVEAAVGGTVTINC

SEQ ID NO: 1024 - protein, 11 aa, Oryctolagus cuniculus
QASENIYRSLA

SEQ ID NO: 1025 - protein, 15 aa, Oryctolagus cuniculus
WYQQKPGQPPKLLIY

SEQ ID NO: 1026 - protein, 7 aa, Oryctolagus cuniculus
SASTLAS

SEQ ID NO: 1027 - protein, 32 aa, Oryctolagus cuniculus; identical to SEQ ID NO: 747

SEQ ID NO: 1028 - protein, 14 aa, Oryctolagus cuniculus
QSYDGSSSSSYGVG

SEQ ID NO: 1029 - protein, 11 aa, Artificial
  Humanized antibody sequence
FGGGTEVVVKR

SEQ ID NO: 1030 - protein, 106 aa, Artificial; identical to SEQ ID NO: 30
  Humanized antibody sequence

SEQ ID NO: 1031 - DNA, 657 bp, Artificial
  Humanized antibody sequence
gatgttgtgatgacccagactccagcctccgtggaggcagctgtgggaggcacagtcaccatcaattgccaggccagtgagaacatttacaggtctttagcctggtatcagcagaaaccagggcagcctcccaagctcctgatctactctgcatccactctggcatctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1032 - DNA, 339 bp, Artificial
  Humanized antibody sequence
gatgttgtgatgacccagactccagcctccgtggaggcagctgtgggaggcacagtcaccatcaattgccaggccagtgagaacatttacaggtctttagcctggtatcagcagaaaccagggcagcctcccaagctcctgatctactctgcatccactctggcatctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgt

SEQ ID NO: 1033 - DNA, 69 bp, Oryctolagus cuniculus
gatgttgtgatgacccagactccagcctccgtggaggcagctgtgggaggcacagtcaccatcaattgc

SEQ ID NO: 1034 - DNA, 33 bp, Oryctolagus cuniculus; identical to SEQ ID NO: 434

SEQ ID NO: 1035 - DNA, 45 bp, Oryctolagus cuniculus; identical to SEQ ID NO: 875

SEQ ID NO: 1036 - DNA, 21 bp, Oryctolagus cuniculus
tctgcatccactctggcatct

SEQ ID NO: 1037 - DNA, 96 bp, Oryctolagus cuniculus; identical to SEQ ID NO: 757

SEQ ID NO: 1038 - DNA, 42 bp, Oryctolagus cuniculus; identical to SEQ ID NO: 278

SEQ ID NO: 1039 - DNA, 33 bp, Artificial; identical to SEQ ID NO: 39
  Humanized antibody sequence

SEQ ID NO: 1040 - DNA, 318 bp, Artificial; identical to SEQ ID NO: 40
  Humanized antibody sequence

SEQ ID NO: 1041 - protein, 440 aa, Artificial
  Humanized antibody sequence
QSLEESGGRLVTPGTSLTLTCTASGFSLSAYDILWVRQAPGKGLESIGMMYDDGDTYYATWAKGRFIISRTSTTMDLKIISPTTEDTATYFCVKGVSNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1042 - protein, 110 aa, Artificial
  Humanized antibody sequence
QSLEESGGRLVTPGTSLTLTCTASGFSLSAYDILWVRQAPGKGLESIGMMYDDGDTYYATWAKGRFIISRTSTTMDLKIISPTTEDTATYFCVKGVSNIWGQGTLVTVSS

SEQ ID NO: 1043 - protein, 29 aa, Oryctolagus cuniculus
QSLEESGGRLVTPGTSLTLTCTASGFSLS

SEQ ID NO: 1044 - protein, 5 aa, Oryctolagus cuniculus
AYDIL

SEQ ID NO: 1045 - protein, 14 aa, Oryctolagus cuniculus
WVRQAPGKGLESIG

SEQ ID NO: 1046 - protein, 16 aa, Oryctolagus cuniculus
MMYDDGDTYYATWAKG

SEQ ID NO: 1047 - protein, 30 aa, Oryctolagus cuniculus
RFIISRTSTTMDLKIISPTTEDTATYFCVK

SEQ ID NO: 1048 - protein, 5 aa, Oryctolagus cuniculus
GVSNI

SEQ ID NO: 1049 - protein, 11 aa, Artificial
  Humanized antibody sequence
WGQGTLVTVSS

SEQ ID NO: 1050 - protein, 330 aa, Artificial; identical to SEQ ID NO: 10
  Humanized antibody sequence

SEQ ID NO: 1051 - DNA, 1320 bp, Artificial
  Humanized antibody sequence
cagtcgctggaggagtccgggggtcgcctggtcacgcctgggacatccctgacactcacctgcacagcctctggattctccctgagtgcctatgacatcctctgggtccgccaggctccagggaagggcctggaatccatcggaatgatgtatgatgatggtgacacatactacgcgacttgggcgaaaggccgattcatcatctccagaacctcgaccacgatggatctgaaaatcatcagtccgacaaccgaggacacggccacctatttctgtgtcaaaggtgtgagtaatatctggggccaaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1052 - DNA, 330 bp, Artificial
  Humanized antibody sequence
cagtcgctggaggagtccgggggtcgcctggtcacgcctgggacatccctgacactcacctgcacagcctctggattctccctgagtgcctatgacatcctctgggtccgccaggctccagggaagggcctggaatccatcggaatgatgtatgatgatggtgacacatactacgcgacttgggcgaaaggccgattcatcatctccagaacctcgaccacgatggatctgaaaatcatcagtccgacaaccgaggacacggccacctatttctgtgtcaaaggtgtgagtaatatctggggccaaggcaccctggtcaccgtctcgagc

SEQ ID NO: 1053 - DNA, 87 bp, Oryctolagus cuniculus
cagtcgctggaggagtccgggggtcgcctggtcacgcctgggacatccctgacactcacctgcacagcctctggattctccctgagt

SEQ ID NO: 1054 - DNA, 15 bp, Oryctolagus cuniculus
gcctatgacatcctc

SEQ ID NO: 1055 - DNA, 42 bp, Oryctolagus cuniculus
tgggtccgccaggctccagggaagggcctggaatccatcgga

SEQ ID NO: 1056 - DNA, 48 bp, Oryctolagus cuniculus
atgatgtatgatgatggtgacacatactacgcgacttgggcgaaaggc

SEQ ID NO: 1057 - DNA, 90 bp, Oryctolagus cuniculus
cgattcatcatctccagaacctcgaccacgatggatctgaaaatcatcagtccgacaaccgaggacacggccacctatttctgtgtcaaa

SEQ ID NO: 1058 - DNA, 15 bp, Oryctolagus cuniculus
ggtgtgagtaatatc

SEQ ID NO: 1059 - DNA, 33 bp, Artificial
  Humanized antibody sequence
tggggccaaggcaccctggtcaccgtctcgagc

SEQ ID NO: 1060 - DNA, 990 bp, Artificial; identical to SEQ ID NO: 20
  Humanized antibody sequence

SEQ ID NO: 1061 - protein, 219 aa, Artificial
  Humanized antibody sequence
DIVMTQIPASVEAAVGGTVTIKCQASQSIDSSLAWYQQKPGQPPKLLIYSASTLASGVPSRFKGSGSGTEFTLTIGDLECADAATYYCQSYDGSSSSYYGIGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1062 - protein, 113 aa, Artificial
  Humanized antibody sequence
DIVMTQIPASVEAAVGGTVTIKCQASQSIDSSLAWYQQKPGQPPKLLIYSASTLASGVPSRFKGSGSGTEFTLTIGDLECADAATYYCQSYDGSSSSYYGIGFGGGTEVVVKR

SEQ ID NO: 1063 - protein, 23 aa, Oryctolagus cuniculus
DIVMTQIPASVEAAVGGTVTIKC

SEQ ID NO: 1064 - protein, 11 aa, Oryctolagus cuniculus
QASQSIDSSLA

SEQ ID NO: 1065 - protein, 15 aa, Oryctolagus cuniculus
WYQQKPGQPPKLLIY

SEQ ID NO: 1066 - protein, 7 aa, Oryctolagus cuniculus
SASTLAS

SEQ ID NO: 1067 - protein, 32 aa, Oryctolagus cuniculus
GVPSRFKGSGSGTEFTLTIGDLECADAATYYC

SEQ ID NO: 1068 - protein, 14 aa, Oryctolagus cuniculus
QSYDGSSSSYYGIG

SEQ ID NO: 1069 - protein, 11 aa, Artificial
  Humanized antibody sequence
FGGGTEVVVKR

SEQ ID NO: 1070 - protein, 106 aa, Artificial; identical to SEQ ID NO: 30
  Humanized antibody sequence

SEQ ID NO: 1071 - DNA, 657 bp, Artificial
  Humanized antibody sequence
gacattgtgatgacccagattccagcctccgtggaggcagctgtgggaggcacagtcaccatcaagtgccaggccagtcagagcattgatagtagcttggcctggtatcagcagaaaccagggcagcctcccaagctcctgatctattctgcatccactctggcatctggggtcccatcgcggttcaaaggcagtggatctgggacagagttcactctcaccatcggcgacctggagtgtgccgatgctgccacttactactgtcaaagctatgatggtagtagtagtagttattatggtattggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1072 - DNA, 339 bp, Artificial
  Humanized antibody sequence
gacattgtgatgacccagattccagcctccgtggaggcagctgtgggaggcacagtcaccatcaagtgccaggccagtcagagcattgatagtagcttggcctggtatcagcagaaaccagggcagcctcccaagctcctgatctattctgcatccactctggcatctggggtcccatcgcggttcaaaggcagtggatctgggacagagttcactctcaccatcggcgacctggagtgtgccgatgctgccacttactactgtcaaagctatgatggtagtagtagtagttattatggtattggtttcggcggagggaccgaggtggtggtcaaacgt

SEQ ID NO: 1073 - DNA, 69 bp, Oryctolagus cuniculus
gacattgtgatgacccagattccagcctccgtggaggcagctgtgggaggcacagtcaccatcaagtgc

SEQ ID NO: 1074 - DNA, 33 bp, Oryctolagus cuniculus; identical to SEQ ID NO: 474

SEQ ID NO: 1075 - DNA, 45 bp, Oryctolagus cuniculus; identical to SEQ ID NO: 35

SEQ ID NO: 1076 - DNA, 21 bp, Oryctolagus cuniculus
tctgcatccactctggcatct

SEQ ID NO: 1077 - DNA, 96 bp, Oryctolagus cuniculus
ggggtcccatcgcggttcaaaggcagtggatctgggacagagttcactctcaccatcggcgacctggagtgtgccgatgctgccacttactactgt

SEQ ID NO: 1078 - DNA, 42 bp, Oryctolagus cuniculus
caaagctatgatggtagtagtagtagttattatggtattggt

SEQ ID NO: 1079 - DNA, 33 bp, Artificial; identical to SEQ ID NO: 39
  Humanized antibody sequence

SEQ ID NO: 1080 - DNA, 318 bp, Artificial; identical to SEQ ID NO: 40
  Humanized antibody sequence

SEQ ID NO: 1081 - protein, 440 aa, Artificial
  Humanized antibody sequence
QSVEESGGRLVTPGTPLTLTCTVSGSSLSDYDMIWVRQAPGKGLESIGIIYDDGDTYYATWAKGRFTISKTSTTVDLRIISPTTEDTATYFCVKGVSNMWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1082 - protein, 110 aa, Artificial
  Humanized antibody sequence
QSVEESGGRLVTPGTPLTLTCTVSGSSLSDYDMIWVRQAPGKGLESIGIIYDDGDTYYATWAKGRFTISKTSTTVDLRIISPTTEDTATYFCVKGVSNMWGPGTLVTVSS

SEQ ID NO: 1083 - protein, 29 aa, Oryctolagus cuniculus
QSVEESGGRLVTPGTPLTLTCTVSGSSLS

SEQ ID NO: 1084 - protein, 5 aa, Oryctolagus cuniculus
DYDMI

SEQ ID NO: 1085 - protein, 14 aa, Oryctolagus cuniculus
WVRQAPGKGLESIG

SEQ ID NO: 1086 - protein, 16 aa, Oryctolagus cuniculus
IIYDDGDTYYATWAKG

SEQ ID NO: 1087 - protein, 30 aa, Oryctolagus cuniculus
RFTISKTSTTVDLRIISPTTEDTATYFCVK

SEQ ID NO: 1088 - protein, 5 aa, Oryctolagus cuniculus
GVSNM

SEQ ID NO: 1089 - protein, 11 aa, Artificial
  Humanized antibody sequence
WGPGTLVTVSS

SEQ ID NO: 1090 - protein, 330 aa, Artificial; identical to SEQ ID NO: 10
  Humanized antibody sequence

SEQ ID NO: 1091 - DNA, 1320 bp, Artificial
  Humanized antibody sequence
cagtcggtggaggagtccgggggtcgcctggtcacgcctgggacacccctgacactcacctgcacagtctctggatcctccctcagtgattatgacatgatctgggtccgccaggctccagggaaggggctggaatccatcgggatcatttatgatgatggtgacacatactacgcgacttgggcgaaaggccgattcaccatctccaaaacctcgaccacggtggatctgagaatcatcagtccgacaaccgaggacacggccacctatttctgtgtcaaaggtgtgagtaatatgtggggcccggggaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1092 - DNA, 330 bp, Artificial
  Humanized antibody sequence
cagtcggtggaggagtccgggggtcgcctggtcacgcctgggacacccctgacactcacctgcacagtctctggatcctccctcagtgattatgacatgatctgggtccgccaggctccagggaaggggctggaatccatcgggatcatttatgatgatggtgacacatactacgcgacttgggcgaaaggccgattcaccatctccaaaacctcgaccacggtggatctgagaatcatcagtccgacaaccgaggacacggccacctatttctgtgtcaaaggtgtgagtaatatgtggggcccggggaccctggtcaccgtctcgagc

SEQ ID NO: 1093 - DNA, 87 bp, Oryctolagus cuniculus
cagtcggtggaggagtccgggggtcgcctggtcacgcctgggacacccctgacactcacctgcacagtctctggatcctccctcagt

SEQ ID NO: 1094 - DNA, 15 bp, Oryctolagus cuniculus
gattatgacatgatc

SEQ ID NO: 1095 - DNA, 42 bp, Oryctolagus cuniculus; identical to SEQ ID NO: 695

SEQ ID NO: 1096 - DNA, 48 bp, Oryctolagus cuniculus
atcatttatgatgatggtgacacatactacgcgacttgggcgaaaggc

SEQ ID NO: 1097 - DNA, 90 bp, Oryctolagus cuniculus
cgattcaccatctccaaaacctcgaccacggtggatctgagaatcatcagtccgacaaccgaggacacggccacctatttctgtgtcaaa

SEQ ID NO: 1098 - DNA, 15 bp, Oryctolagus cuniculus
ggtgtgagtaatatg

SEQ ID NO: 1099 - DNA, 33 bp, Artificial
  Humanized antibody sequence
tggggcccggggaccctggtcaccgtctcgagc

SEQ ID NO: 1100 - DNA, 990 bp, Artificial; identical to SEQ ID NO: 20
  Humanized antibody sequence

SEQ ID NO: 1101 - protein, 219 aa, Artificial
  Humanized antibody sequence
DVVMTQTPSSVSAAVGGTVTIKCQASQSIGSSLAWYQQKPGQRPKLLIYAASTLASGVPSRFKGSGSGTEFTLTISDLECADAATYYCQSYDGSSSSSYGVGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1102 - protein, 113 aa, Artificial
  Humanized antibody sequence
DVVMTQTPSSVSAAVGGTVTIKCQASQSIGSSLAWYQQKPGQRPKLLIYAASTLASGVPSRFKGSGSGTEFTLTISDLECADAATYYCQSYDGSSSSSYGVGFGGGTEVVVKR

SEQ ID NO: 1103 - protein, 23 aa, Oryctolagus cuniculus
DVVMTQTPSSVSAAVGGTVTIKC

SEQ ID NO: 1104 - protein, 11 aa, Oryctolagus cuniculus
QASQSIGSSLA

SEQ ID NO: 1105 - protein, 15 aa, Oryctolagus cuniculus
WYQQKPGQRPKLLIY

SEQ ID NO: 1106 - protein, 7 aa, Oryctolagus cuniculus
AASTLAS

SEQ ID NO: 1107 - protein, 32 aa, Oryctolagus cuniculus; identical to SEQ ID NO: 747

SEQ ID NO: 1108 - protein, 14 aa, Oryctolagus cuniculus
QSYDGSSSSSYGVG

SEQ ID NO: 1109 - protein, 11 aa, Artificial
  Humanized antibody sequence
FGGGTEVVVKR

SEQ ID NO: 1110 - protein, 106 aa, Artificial; identical to SEQ ID NO: 30
  Humanized antibody sequence

SEQ ID NO: 1111 - DNA, 657 bp, Artificial
  Humanized antibody sequence
gacgtcgtgatgacccagactccatcctccgtgtctgcagctgtgggaggcacagtcaccatcaagtgccaggccagtcagagcattggtagtagcttagcctggtatcagcagaaaccagggcagcgtcccaagctcctgatctatgctgcatccactctggcatctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1112 - DNA, 339 bp, Artificial
  Humanized antibody sequence
gacgtcgtgatgacccagactccatcctccgtgtctgcagctgtgggaggcacagtcaccatcaagtgccaggccagtcagagcattggtagtagcttagcctggtatcagcagaaaccagggcagcgtcccaagctcctgatctatgctgcatccactctggcatctggggtcccatcgcggttcaaaggcagtggatctgggacagagttcactctcaccatcagcgacctggagtgtgccgatgctgccacttactactgtcaaagctatgatggtagtagtagtagtagttatggtgttggtttcggcggagggaccgaggtggtggtcaaacgt

SEQ ID NO: 1113 - DNA, 69 bp, Oryctolagus cuniculus
gacgtcgtgatgacccagactccatcctccgtgtctgcagctgtgggaggcacagtcaccatcaagtgc

SEQ ID NO: 1114 - DNA, 33 bp, Oryctolagus cuniculus; identical to SEQ ID NO: 554

SEQ ID NO: 1115 - DNA, 45 bp, Oryctolagus cuniculus
tggtatcagcagaaaccagggcagcgtcccaagctcctgatctat

SEQ ID NO: 1116 - DNA, 21 bp, Oryctolagus cuniculus
gctgcatccactctggcatct

SEQ ID NO: 1117 - DNA, 96 bp, Oryctolagus cuniculus; identical to SEQ ID NO: 757

SEQ ID NO: 1118 - DNA, 42 bp, Oryctolagus cuniculus; identical to SEQ ID NO: 278

SEQ ID NO: 1119 - DNA, 33 bp, Artificial; identical to SEQ ID NO: 39
  Humanized antibody sequence

SEQ ID NO: 1120 - DNA, 318 bp, Artificial; identical to SEQ ID NO: 40
  Humanized antibody sequence

SEQ ID NO: 1121 - protein, 39 aa, Homo sapiens
SYSMEHFRWGKPVGKKRRPVKVYPNGAEDESAEAFPLEF

SEQ ID NO: 1122 - protein, 24 aa, Homo sapiens
SYSMEHFRWGKPVGKKRRPVKVYP

SEQ ID NO: 1123 - protein, 13 aa, Homo sapiens
SYSMEHFRWGKPV

SEQ ID NO: 1124 - protein, 22 aa, Homo sapiens
RPVKVYPNGAEDESAEAFPLEF

SEQ ID NO: 1125 - protein, 13 aa, Homo sapiens
  Acetylation (1)..(1)
  Amidation (13)..(13)
SYSMEHFRWGKPV

What is claimed is:

1. An anti-human adrenocorticotrophic hormone (ACTH) antibody or antibody fragment comprising the heavy chain CDR1, CDR2, and CDR3 polypeptides of SEQ ID NO: 404; SEQ ID NO: 406; and SEQ ID NO: 408, and the light chain CDR1, CDR2, and CDR3 polypeptides of SEQ ID NO: 424; SEQ ID NO: 426; and SEQ ID NO: 428.

2. An anti-human adrenocorticotrophic hormone (ACTH) antibody or antibody fragment according to claim 1 that is humanized or chimerized.

3. An anti-human ACTH antibody or antibody fragment according to claim 1, wherein said antibody or antibody fragment is humanized.

4. The anti-human ACTH antibody of claim 1, which comprises a variable heavy chain having at least 90% identity to the polypeptide of SEQ ID NO: 402 and/or which comprises a variable light chain having at least 90% identity to the polypeptide of SEQ ID NO: 422, or comprises said variable light chain and said variable heavy chain.

5. The anti-human ACTH antibody of claim 1, which comprises a heavy chain having at least 90% identity to the polypeptide of SEQ ID NO: 401 and/or which comprises a light chain having at least 90% identity to the polypeptide of SEQ ID NO: 421, or comprises said light chain and said heavy chain.

6. The anti-human ACTH antibody of claim 1, which comprises or consists of the variable heavy chain of SEQ ID NO: 402 and the variable light chain of SEQ ID NO: 422, or comprises or consists of the heavy chain of SEQ ID NO: 401 and the light chain of SEQ ID NO: 421.

7. The anti-human ACTH antibody or antibody fragment of claim 1, wherein the antibody or antibody fragment
   (i) is selected from the group consisting of scFvs, Fab fragments, Fab' fragments, monovalent antibody fragments, and F(ab')2 fragments; or
   (ii) the antibody comprises an unmodified IgG1, IgG2, IgG3, or IgG4 constant domain or
   (iii) the antibody or antibody fragment comprises an IgG1, IgG2, IgG3, or IgG4 constant domain that has been modified to alter at least one of effector function, half-life, proteolysis, or glycosylation.

8. A composition comprising at least one anti-human ACTH antibody or antibody fragment according to claim 1.

9. The anti-human ACTH antibody of claim 1, which comprises a variable heavy chain having at least 95% identity to the polypeptide of SEQ ID NO: 402 and/or which comprises a variable light chain having at least 95% identity to the polypeptide of SEQ ID NO: 422.

10. The anti-human ACTH antibody of claim 1, which comprises a variable heavy chain polypeptide of SEQ ID NO: 402 and/or which comprises a variable light chain polypeptide of SEQ ID NO: 422.

11. The anti-human ACTH antibody of claim 1, which consists of the heavy chain of SEQ ID NO: 401 and the light chain of SEQ ID NO: 421.

* * * * *